(12) United States Patent
Argyros et al.

(10) Patent No.: US 11,753,656 B2
(45) Date of Patent: Sep. 12, 2023

(54) METHODS FOR THE IMPROVEMENT OF PRODUCT YIELD AND PRODUCTION IN A MICROORGANISM THROUGH GLYCEROL RECYCLING

(71) Applicant: LALLEMAND HUNGARY LIQUIDITY MANAGEMENT LLC, Budapest (HU)

(72) Inventors: Aaron Argyros, Etna, NH (US); William R. Kenealy, Carlsbad, CA (US); Emily Stonehouse, Etna, NH (US)

(73) Assignee: LALLEMAND HUNGARY LIQUIDITY MANAGEMENT LLC, Budapest (HU)

( * ) Notice: Subject to any disclaimer, the term of this patent is extended or adjusted under 35 U.S.C. 154(b) by 0 days.

(21) Appl. No.: 14/911,102

(22) PCT Filed: Aug. 15, 2014

(86) PCT No.: PCT/US2014/051355
§ 371 (c)(1),
(2) Date: Feb. 9, 2016

(87) PCT Pub. No.: WO2015/023989
PCT Pub. Date: Feb. 19, 2015

(65) Prior Publication Data
US 2016/0194669 A1    Jul. 7, 2016

Related U.S. Application Data

(60) Provisional application No. 61/866,338, filed on Aug. 15, 2013.

(51) Int. Cl.
| | |
|---|---|
| *C12P 7/06* | (2006.01) |
| *C12N 9/00* | (2006.01) |
| *C12N 9/04* | (2006.01) |
| *C12N 1/22* | (2006.01) |
| *C07K 14/395* | (2006.01) |
| *C12N 1/32* | (2006.01) |
| *C12N 15/81* | (2006.01) |
| *C12P 7/04* | (2006.01) |

(52) U.S. Cl.
CPC .............. *C12P 7/06* (2013.01); *C07K 14/395* (2013.01); *C12N 1/22* (2013.01); *C12N 1/32* (2013.01); *C12N 9/0006* (2013.01); *C12N 15/81* (2013.01); *C12P 7/04* (2013.01); *C12Y 101/01008* (2013.01); *Y02E 50/10* (2013.01)

(58) Field of Classification Search
CPC ................................. C12N 9/0006; C12P 7/06
See application file for complete search history.

(56) References Cited

U.S. PATENT DOCUMENTS

| | | |
|---|---|---|
| 5,422,267 A | 6/1995 | Yocum et al. |
| 7,226,776 B2 | 6/2007 | Ingram et al. |
| 7,846,712 B2 | 12/2010 | Zhang et al. |
| 2006/0257983 A1 | 11/2006 | Bro et al. |
| 2008/0293125 A1 | 11/2008 | Subbian et al. |
| 2011/0189744 A1 | 8/2011 | Mcbride et al. |
| 2011/0312054 A1 | 12/2011 | Brevnova et al. |
| 2012/0003701 A1 | 1/2012 | Brevnova et al. |
| 2012/0064622 A1 | 3/2012 | Fischer et al. |
| 2013/0273555 A1 | 10/2013 | Sillers et al. |

(Continued)

FOREIGN PATENT DOCUMENTS

| | | |
|---|---|---|
| CN | 101970641 A | 2/2011 |
| EP | 2 277 989 A1 | 1/2011 |
| EP | 3033413 B1 | 6/2020 |

(Continued)

OTHER PUBLICATIONS

Wang. Increasing ethanol titer and yield in a gpd1D gpd2D strain by simultaneous overexpression of GLT1 and STL1 in *Saccharomyces cerevisiae*. Biotechnol Lett (2013) 35:1859-1864.*

(Continued)

*Primary Examiner* — Yong D Pak
(74) *Attorney, Agent, or Firm* — STERNE, KESSLER, GOLDSTEIN & FOX P.L.L.C.

(57) ABSTRACT

The present invention provides for novel metabolic pathways to reduce or modulate glycerol production and increase product formation. More specifically, the invention provides for a recombinant microorganism comprising one or more native and/or heterologous proteins that function to import glycerol and one or more native and/or heterologous enzymes that function in one or more engineered metabolic pathways to convert a carbohydrate source, such as lignocellulose, to a product, such as ethanol, wherein the one or more native and/or heterologous proteins or enzymes is activated, upregulated, or downregulated. The invention also provides for a recombinant microorganism comprising one or more native or heterologous proteins that function to regulate glycerol synthesis and one or more native and/or heterologous enzymes that function in one or more engineered metabolic pathways to convert a carbohydrate source to ethanol, wherein said one or more native and/or heterologous proteins or enzymes is activated, upregulated or downregulated. Also provided are methods for increasing cellular glycerol uptake and increasing recombinant production of fuels and other chemicals using the recombinant microorganisms of the invention.

25 Claims, 18 Drawing Sheets

Specification includes a Sequence Listing.

(56) References Cited

U.S. PATENT DOCUMENTS

| | | |
|---|---|---|
| 2013/0323822 A1 | 12/2013 | Brevnova et al. |
| 2014/0256011 A1* | 9/2014 | Zelle .................. C12P 7/10 |
| | | 435/161 |

FOREIGN PATENT DOCUMENTS

| | | | |
|---|---|---|---|
| WO | | 2006/009434 A1 | 1/2006 |
| WO | | 2008/006037 A2 | 1/2008 |
| WO | | 2009/138877 A2 | 11/2009 |
| WO | WO 2009/143495 | * | 11/2009 |
| WO | | 2010/056805 A2 | 5/2010 |
| WO | | 2010/060056 A2 | 5/2010 |
| WO | | 2010/075529 A2 | 7/2010 |
| WO | | 2011/140386 A2 | 11/2011 |
| WO | | 2011/149353 A1 | 12/2011 |
| WO | | 2011/153516 A2 | 12/2011 |
| WO | | 2012/067510 A1 | 5/2012 |
| WO | | 2012/138942 A1 | 10/2012 |
| WO | WO-2012138942 A1 * | 10/2012 | .......... C12N 9/0008 |
| WO | | 2014/074895 A2 | 5/2014 |
| WO | | 2014/081803 A1 | 5/2014 |
| WO | WO 2014/081803 | * | 5/2014 |
| WO | | 2014/160402 A1 | 10/2014 |
| WO | WO-2015023989 A1 | | 2/2015 |

OTHER PUBLICATIONS

Zhao. The STL1 gene of *Saccharomyces cerevisiae* is predicted to encode a sugar transporter-like protein. Gene. Sep. 2, 1994;146(2):215-9.*

Ansell, R., et al., "The two isoenzymes for yeast NAD+-dependent glycerol 3-phosphate dehydrogenase encoded by GDP1 and GDP2 have distinct roles in osmoadaptation and redox regulation," The EMBO Journal 16(9):2179-2187, Nature Publishing Group, England (1997).

Argueso, J. L., et al., "Genome structure of a *Saccharomyces cerevisiae* strain widely used in bioethanol production," Genome Res., 2009, v19, pp. 2258-2270.

Bro, C., et al., "In silico aided metabolic engineering of *Saccharomyces cerevisiae* for improved bioethanol production," Metabolic Engineering 8:102-111, Elsevier Inc., United States (2006).

Cadiére, A., et al., "The *Saccharomyces cerevisiae* zinc factor protein Stb5p is required as a basal regulator of the pentose phosphate pathway," FEMS Yeast Research 10:819-827 (2010).

Della-Bianca, B. E., et al., "What do we know about the yeast strains from the Brazilian fuel ethanol industry?," Appl. Microbiol. Biotechnol., 2013, v. 97, pp. 979-991.

Desai, S.G., et al., "Cloning of L-lactate dehydrogenase and elimination of lactic acid production via gene knockout in *Thermoanaerobacterium saccharolyticum* JW/SL-YS485," Appl Microbiol Biotechnol. Oct. 2004;65(5):600-5. Epub Mar. 6, 2004.

Ferreira, C., et al., "A member of the sugar transporter family, Stl1p is the glycerol/H+ symporter in *Saccharomyces cerevisiae*," Molec. Biol. of the Cell, Amer. Soc. Cell. Biol., 2005, v. 16, pp. 2068-2076.

Gonzalez, B., et al., "A rapid and reliable method for metabolite extraction in yeast using boiling buffered ethanol," Yeast. Nov. 1997;13(14):1347-55.

Guo, Z., et al., "Minimization of glycerol synthesis in industrial ethanol yeast without influencing its fermentation performance," Metabolic Engineering 13(1):49-59, Elsevier, Inc., United States (Jan. 2011).

Hartzog, P.E., et al., "Cytosine deaminase MX cassettes as positive/negative markers in *Saccharomyces cerevisiae*," Yeast 22:789-98, Wiley InterScience, England (2005).

Hohmann, S., et al., "Yeast osmoregulation," Methods Enzymol. 2007;428:29-45.

International Search Report and Written Opinion for Application No. PCT/US2014/051355, dated Nov. 25, 2014 (15 pages).

Jeppsson, M., et al., Reduced Oxidative Pentose Phosphate Pathway Flux in Recombinant Xylose-Utilizing *Saccharomyces cerevisiae* Strains Improves the Ethanol Yield from Xylose, Appl. Environ. Microbiol. 68 (4):1604-1609, American Society for Microbiology, Washington, United States (2002).

Jules, M., et al., "New Insights into Trehalose Metabolism by *Saccharomyces cerevisiae*: NTH2 Encodes a Functional Cytosolic Trehalase, and Deletion of TPS1 Reveals Ath1p-Dependent Trehalose Mobilization," Appl Environ Microbiol. Feb. 2008; 74(3): 605-614.

Karhumaa, K., et al., "Comparison of xylose reductase-xylitol dehydrogenase and the xylose isomerase pathways for xylose fermentation by recombinant *Saccharomyces cerevisiae*," Microbial Cell Factories 6(5):1-10, BioMed Central, England (2007).

Kayingo, G., et al., "A permease encoded by STL1 is required for active glycerol uptake by *Candida albicans*," Microbiology, 2009, v. 155, pp. 1547-1557.

Kuyper, M., et al., "Evolutionary engineering of mixed-sugar utilization by a xylose-fermenting *Saccharomyces cerevisiae* strain," FEMS Yeast Res. Jul. 2005;5(10):925-34.

Kuyper M., et al., "Metabolic engineering of a xylose-isomerase-expressing *Saccharomyces cerevisiae* strain for rapid anaerobic xylose fermentation," FEMS Yeast Res. Feb. 2005;5(4-5):399-409.

Kuyper M., et al., "Minimal metabolic engineering of *Saccharomyces cerevisiae* for efficient anaerobic xylose fermentation: a proof of principle," FEMS Yeast Res. Mar. 2004;4(6):655-64.

Leal, T.F. and De Sá-Nogueira, I., "Purification, characterization and functional analysis of an endo-arabinose (AbnA) from *Bacillus subtilis*," FEMS Microbiol. Let., 241:41-48, Elsevier, B.V., Netherlands (2004).

Lidén, G., et al., "A Glycerol-3-Phosphate Dehydrogenase-Deficient Mutant of *Saccharomyces cerevisiae* Expressing the Heterologous XYL1 Gene," Appl. Environ. Microbiol., 62(10):3894-3896, American Society for Microbiology, United States (1996).

Lynd, L.R., et al., "Microbial Cellulose Utilization: Fundamentals and Biotechnology," Microbiology and Molecular Biology Reviews, 66(3):506-577, American Society for Microbiology, United States (2002).

McLaughlin, S.B., et al., "High-value renewable energy from prairie grasses," Environ Sci Technol. May 15, 2002;36 (10):2122-29.

Medina, V.G., et al., "Elimination of Glycerol Production in Anaerobic Cultures of a *Saccharomyces cerevisiae* Strain Engineered to Use Acetic Acid as an Electron Acceptor," Applied and Environmental Microbiology, 76(1):190-195, American Society for Microbiology., United States (Jan. 2010).

Modig, T., et al., "Anaerobic glycerol production by *Saccharomyces cerevisiae* strains under hyperosmotic stress," Appl Microbiol Biotechnol. May 2007;75(2):289-96. Epub Jan. 13, 2007.

Mota, L.J., et al., "Control of the Arabinose Regulon in *Bacillus subtilis* by AraR In Vivo: Crucial Roles of Operators, Cooperativity, and DNA Looping," J. Bacteriol., 183(14):4190-4201, American Society for Microbiology, United States (2001).

Mota, L.J., et al., "Mode of action of AraR, the key regulator of L-Arabinose metabolism in *Bacillus subtilis*," Molec. Microbiol., 33(3):476-489, Blackwell Science Ltd., England (1999).

Nielsen, J., et al., Metabolic engineering of yeast for production of fuels and chemicals, Current Opinion in Biotechnology, 24:1-7, Elsevier Ltd., England (2013).

Páhlman, A-K., et al., "The Yeast Glycerol 3-Phosphatases Gpp1p and Gpp2p are Required for Glycerol Biosynthesis and Differentially Involved in the Cellular Response to Osmotic, Anaerobic, and Oxidative Stress," J. Biol. Chem., 276(5):3555-3563, American Society for Biochemistry and Molecular Biology, United States (2001).

Petrovska, B., et al., "Glycerol production by yeasts under osmotic and sulfite stress," Can J Microbiol. Aug. 1999;45 (8):695-9.

Remize, F., et al., "Glycerol Export and Glycerol-3-phosphate Dehydrogenase, but Not Glycerol Phosphatase, are Rate Limiting for Glycerol Production in *Saccharomyces cerevisiae*," Metab. Eng. 3:301-12, Academic Press, United States (2001).

Remize, F., et al., "Glycerol overproduction by engineered (No Suggestions) cerevisiae wine yeast strains leads to substantial changes in By-product formation and to a stimulation of fermentation rate in stationary phase," Appl Environ Microbiol. Jan. 1999;65(1):143-9.

(56) References Cited

OTHER PUBLICATIONS

Sá-Nogueira, I., et al, "The Bacillus subtilis L-arabinose (ara) operon: nucleotide sequence, genetic organization and expression," Microbiology, 143:957-969, Society for General Microbiology, Great Britain (1997).
Schleif, R., "Regulation of the L-arabinose operon of *Escherichia coli*," Trends in Genet. 16(1 2):559-65, Elsevier Science, Ltd., England (2000).
Stairs, C.W., et al., "Eukaryotic pyruvate formate lyase and its activating enzyme were acquired laterally from a firmicute," Molecular Biology and Evolution, 2011, v28, pp. 2087-2099.
Tamás, M.J., et al., "Fps1p controls the accumulation and release of the compatible solute glycerol in yeast osmoregulation," Molecular Microbiology, 31(4):1087-1104, Blackwell Science Ltd, England (1999).
Tulha, J., et al., "*Saccharomyces cerevisiae* glycerol/H+ symporter Stl1p is essential for cold/near-freeze and freeze stress adaptation. A simple recipe with high biotechnological potential is given," Microb Cell Fact. 2010; 9: 82.
Van Walsum et al., "Allocation of ATP to synthesis of cells and hydrolytic enzymes in cellulolytic fermentative microorganisms: Bioenergetics, kinetics, and bioprocessing," Biotech. Bioeng., 58:316-320, (1998).
Verduyn, C. et al., "Effect of benzoic acid on metabolic fluxes in yeasts: a continuous-culture study on the regulation of respiration and alcoholic fermentation," Yeast, 1992, 8(7), 501-17.
Waks, Z. and Silver, P. A., "Engineering a Synthetic Dual-Organism System for Hydrogen Production," Appl.. Env. Microbiol., 75(7):1867-1875, American Society for Microbiology, United States (Apr. 2009).
Watanabe, S., et al., "Cloning, Expression, and Characterization of Bacterial L-Arabinose 1-Dehydrogenase Involved in an Alternative Pathway of L-Arabinose Metabolism," J. Biol. Chem., 281(5):2612-2623, American Society for Biochemistry and Molecular Biology, United States (2006).
Yang, R.D., et al., "Pilot plant studies of ethanol production from whole ground corn, corn flour, and starch," Fuel Alcohol U.S.A., 1982, v. 4:2.
Yu, K. O., et al., "Engineering of glycerol utilization pathway for ethanol production by *Saccharomyces cerevisiae*," Bioresour. Technol. Jun. 2010;101(11):4157-61; Epub Feb. 9, 2010.
Yu, K. O., et al., "Reduction of glycerol production to improve ethanol yield in an engineered *Saccharomyces cerevisiae* using glycerol as a substrate," J. Biotechnol., 2010, v. 150, pp. 209-214.
International Preliminary Report on Patentability for Application No. PCT/US2014/051355, dated Feb. 25, 2016 (12 pages).
Brazilian Office Action for Application No. BR112016002359.5 dated Jan. 7, 2019. 5 pages. (Informal English translation).
Chinese Office Action for Application No. 201480056417.8 dated Nov. 23, 2018. 20 pages.
Examination Report for Canadian Patent Application No. 2,920,114 dated Jun. 11, 2020. 5 pages.
Examination Report for Canadian Patent Application No. 2,920,114 dated Jun. 4, 2019. 5 pages.
Examination Report for European Application No. EP 14 756 202.9 dated Jan. 15, 2018. 4 pages.
Examination Report for European Application No. EP 14 756 202.9 dated Mar. 27, 2017. 4 pages.
Summons to attend oral proceedings for European Application No. 14 756 202.9 dated Mar. 25, 2019. 4 pages.
Examination Report for Indian Patent Application No. 201617005205 dated Mar. 16, 2020. 7 pages.
Mexican Office Action for Application No. MX/a/2016/001881 dated Jan. 13, 2020. 8 pages. English translation by Google translate.
Lages, F., et al., "Characterization of glycerol/H+ symport in the halotolerant yeast *Pichia sorbitophila*," Yeast vol. 11, pp. 111-119 (1995).
Liu, X., et al., "Expression and functional studies of genes involved in transport and metabolism of glycerol in Pachysolen tannophilus," Microbial Cell Factories, vol. 12, p. 27 (2013).
Neves, L., et al., "Yeast orthologues associated with glycerol transport and metabolism," FEMS Yeast Research, vol. 5, pp. 51-62 (2004).
Notice of Opposition for European Patent Application No. 14756202.9, dated Mar. 30, 2021. 30 pages.
"Provision of the minutes—opposition procedure" and "Minutes of the oral proceedings (Opposition Division)—conclusion of the proceedings" mailed on Nov. 4, 2022, in European Application No. EP 14 756 202.9, filed Aug. 15, 2013, 12 pages.
Ethanol Red Product brochure, "A 23.5 MGY per year ethanol plant improves profitability by $850 K per year by converting to Ethanol Red dry yeast," 2 pages (Jan. 2008).
Leaf by Lesaffre, "Making ethanol from lignocellulosic feedstocks," retrieved at URL:[https://leaf-lesaffre.com/ethanol-innovation/cellulosic-ethanol/], retrieved on Sep. 12, 2022, 6 pages.
Wallace-Salinas, V., et al., "Adaptive evolution of an industrial strain of *Saccharomyces cerevisiae* for combined tolerance to inhibitors and temperature," Biotechnologies for Biofuels 6(1):151, BioMed Central Ltd., United Kingdom (Oct. 2013).
Office Action dated Nov. 18, 2022, in U.S. Appl. No. 17/818,270, Argyros, A. et al., filed Aug. 8, 2022, 48 pages.
UniprotKB, "Piso0_000018 protein," Accession No. G8YUB5_PICSO, 571 amino acids, accessed at URL:[https://rest.uniprot.org/uniprotkb/G8YUB5.txt], 1 page (2012).
Ruohonen, L., et al., "Modifications to the ADH1 promoter of *Saccharomyces cerevisiae* for efficient production of heterologous proteins," J Biotechnol 39(3):193-203, Elsevier, Netherlands (May 1995).
"Interlocutory decision in opposition proceedings" and "Grounds for the decision (Annex)—opposition" mailed on Nov. 4, 2022, in European Application No. EP 14 756 202.9, filed Aug. 15, 2013, 20 pages.
Van Dijken, J., et al., Redox balances in the metabolism of sugars by yeasts (NAD(H); NADP(H); glucose metabolism; xylose fermentation; ethanol; Crabtree effect; Custers effect), *Fems Microbiology Reviews* 32:199-224 (1986).
Klein, M, et al., Glycerol metabolism and transport in yeast and fungi: established knowledge and ambiguities, *Environ Microbiol.* 19(3):878-893 (Mar. 2017).
Flores, C., et al., Carbohydrate and energy-yielding metabolism in non-conventional yeasts, *FEMS Microbiology Reviews* 24:507-529 (2000).
Hubmann, G., et al., Gpd1 and Gpd2 Fine-tuning for Sustainable Reduction of Glycerol Formation in *Saccharomyces cerevisiae*, *Applied and Environmental Microbiology* 77(17):5857-5867 (2011).
Panchal, C.J., et al., The effect of osmotic pressure on the production and excretion of ethanol and glycerol by a brewing yeast strain, *J. Ins. Brew.* 86:207-210 (1980).
Albertyn, J. et al., GPD1, Which Encodes Glycerol-3-Phosphate Dehydrogenase, is Essential for Growth under Osmotic Stress in *Saccharomyces cerevisiae*, and Its Expression is Regulated by the High-Osmolarity Glycerol Response Pathway, Mol. and Cell. Bio. 14(6):4135-4144 (1994).
Zhang, A., et al., Effect of FPS1 deletion on the fermentation properties of *Saccharomyces cerevisiae*, Letters in Applied Microbiology, 44: 212-217 (2006).
Zhang, A., et al., Improve Ethanol Yield Through Minimizing Glycerol Yield in Ethanol Fermentation of *Saccharomyces cerevisiae*, *Chinese Journal of Chemical Engineering* 16(4):620-625 (2008).
Tilloy, V., et al., Reduction of Ethanol Yield and Improvement of Glycerol Formation by Adaptive Evolution of the Wine Yeast *Saccharomyces cerevisiae* under Hyperosmotic Conditions, *Applied and Environmental Microbiology* 80(8):2623-2632 (2014).
Brumm, P.J., et al., Glycerol Production in Industrial Alcohol Fermentations, *Biotechnology Letters* 10(9):677-682 (1988).
Wang, Z., et al., glycerol production by microbial fermentation: A review, *Biotechnology Advances* 19:201-223 (2001).

* cited by examiner

METHODS FOR THE IMPROVEMENT OF PRODUCT YIELD AND PRODUCTION IN A MICROORGANISM THROUGH GLYCEROL RECYCLING

CROSS REFERENCE TO RELATED APPLICATIONS

The present application is a '371 U.S. national phase application of PCT/US2014/051355, filed Aug. 15, 2014, entitled "METHODS FOR THE IMPROVEMENT OF PRODUCT YIELD AND PRODUCTION IN A MICROORGANISM THROUGH GLYCEROL RECYCLING," which claims priority to U.S. Provisional Application No. 61/866,338, filed Aug. 15, 2013, each application of which is hereby incorporated by reference in its entirety.

REFERENCE TO SEQUENCE LISTING SUBMITTED ELECTRONICALLY VIA EFS-WEB

The content of the electronically submitted sequence listing (Name: 115235-222SeqList.txt; Size: 878,927 bytes; Date of Creation: Feb. 8, 2016) is in accordance with 37 C.F.R. § 1.821-1.825, and is incorporated by reference in its entirety.

BACKGROUND OF THE INVENTION

The conversion of biomass, such as corn, sugarcane or other energy crops, as well as simple sugars, to ethanol is routinely completed through the use of yeast fermentation. However, during yeast metabolism a major by-product of fermentation is glycerol.

Glycerol is a required metabolic end-product of native yeast ethanol fermentation allowing the yeast to balance its redox state and regenerate $NAD^+$ used as a cofactor during glycolysis. During anaerobic growth on carbohydrates, production of ethanol and carbon dioxide is redox neutral, while the reactions that create cell biomass and associated carbon dioxide are more oxidized relative to carbohydrates. The production of glycerol, which is more reduced relative to carbohydrates, functions as an electron sink to off-set cell biomass formation, so that overall redox neutrality is conserved. This is essential from a theoretical consideration of conservation of mass, and in practice strains unable to produce glycerol are unable to grow under anaerobic conditions.

As glycerol is a byproduct with low value, it can be an undesirable by-product of fermentation. There is a strong commercial incentive to reduce glycerol as a by-product during the production of fuels and chemicals, as reduction typically results in an increased yield of the desired compound. Thus, it would be beneficial to reduce or eliminate the endogenous production of this by-product and further direct more carbon towards desired end-products, such as ethanol and other fuels and chemicals, including but not limited to isopropanol.

Several strategies are available in the art for the conversion of glycerol to higher value products though biochemical or other means. In addition, various strategies have been employed to reduce glycerol production, which may lead to an improvement of overall sugar yield to ethanol or other desired end-products of metabolism. See Nielsen, J., et al. "Metabolic engineering of yeast for production of fuels and chemicals," *Curr. Opin. Biotechnol.* 24:1-7 (2013). Through engineering of alternate pathways, with the simultaneous reduction or deletion of the glycerol pathway, alternate or replacement electron acceptors for the regeneration of $NAD^+$ can be used during yeast metabolism. Examples of such alternate or replacement electron acceptors include molecules such as formate or hydrogen.

The elimination of glycerol synthesis genes has been demonstrated but removal of this pathway completely blocked anaerobic growth of the yeast, preventing useful application during an industrial process. Ansell, R., et al., *EMBO J.* 16:2179-87 (1997); Pahlman, A-K., et al., *J. Biol. Chem.* 276:3555-63 (2001); Guo, Z P., et al., *Metab. Eng.* 13:49-59 (2011). Other methods to bypass glycerol formation require the co-utilization of additional carbon sources, such as xylose or acetate, to serve as electron acceptors. Lidén, G., et al., *Appl. Env. Microbiol.* 62:3894-96 (1996); Medina, V. G., et al., *Appl. Env. Microbiol.* 76:190-195 (2010). The engineering of a pyruvate formate lyase from *E. coli*, which is capable of converting pyruvate to formate, was performed previously to increase formate production. Waks, Z., and Silver, P. A., *Appl. Env. Microbiol.* 75:1867-1875 (2009). As demonstrated in International Application No. WO 2012/138942, which is incorporated by reference herein in its entirety, incorporation of a formate pathway as an alternate electron acceptor allows for glycerol formation to be bypassed and ethanol yield to be increased.

In addition to its known role during anaerobic growth, glycerol is also synthesized by *S. cerevisiae* in response to osmotic stress. The formation of glycerol is mediated in part by the activity of two glycerol-3-phosphate dehydrogenases: GPD1 and GPD2. Glycerol formed in response to osmotic stress is mediated primarily through the action of GPD1, whereas glycerol formed as an electron sink for excess electrons generated during production of biomass during anaerobic growth is mediated primarily through the action of GPD2. See Ansell, et al., "The two isoenzymes for yeast $NAD^+$-dependent glycerol 3-phosphate dehydrogenase encoded by GPD1 and GPD2 have distinct roles in osmoadaptation and redox regulation," The EMBO Journal 16:2179-87 (1997). Glycerol is exported from the yeast cell through an aquaporin channel known as FPS1. This channel is closed in response to osmotic stress in order to reduce glycerol efflux from the cell, thereby enabling accumulation of higher levels of intracellular glycerol. See Remize, F., et al., "Glycerol Export and Glycerol-3-phosphate Dehydrogenase, but Not Glycerol Phosphatase, Are Rate Limiting for Glycerol Production in *Saccharomyces cerevisiae*," *Metabol. Engineering* 3:301-12 (2001). In addition, the yeast cell can increase intracellular glycerol levels through uptake of glycerol from the extracellular environment through the action of another glycerol transporter known as STL1. The expression of STL1, however, is limited by transcriptional repression of the gene in the presence of glucose. See Ferreira, C., et al., "A Member of the Sugar Transporter Family, Stl1p Is the Glycerol/$H^+$ Symporter in *Saccharomyces cerevisiae*," *Mol. Biol. Cell* 16:2068-76 (2005) and Tulha, J., et al., "*Saccharomyces cerevisiae* glycerol/$H^+$ symporter Stl1p is essential for cold, near-freeze, and freeze stress adaptation. A simple recipe with high biotechnological potential is given," *Microb. Cell Factories* 9:82 (2010).

The production of glycerol in response to osmotic stress has been identified and reviewed. See Petrovska, B. et al., "Glycerol production by yeasts under osmotic and sulfite stress," *Can J Microbiol* 45:695-699 (1999) and Hohmann, et al., "Yeast Osmoregulation," *Methods in Enzymology* 428:29-45 (2007). Anaerobic glycerol production in response to osmotic stress, however, cannot occur in the absence of an accompanying oxidation reaction. Under anaerobic conditions, a yeast strain in stationary phase needs to generate reducing power to make glycerol in response to osmotic stress. The net result is that in addition to making glycerol in response to osmotic stress, the organism must also make an oxidized end product which further reduces the yield of the desired product.

It has been shown that an increase in acetate, pyruvate and succinate production accompanies anaerobic glycerol production in response to osmotic stress. See Modig, T., et al., "Anaerobic glycerol production by *Saccharomyces cerevisiae* strains under hyperosmotic stress," *Appl Microbiol Biotechnol* 75:289-96 (2007). The concentration of these metabolites, however, was only sufficient to produce approximately half of the necessary NADH needed to balance the increase in glycerol. In a separate study, elevated levels of pyruvate, succinate, acetaldehyde, acetoin and 2,3-butanediol were observed in wine strains engineered to produce more glycerol. See Remize, D. F., et al., "Glycerol Overproduction by Engineered *Saccharomyces cerevisiae* Wine yeast Strains Leads to Substantial Changes in By-Product Formation and to a Stimulation of Fermentation Rate in Stationary Phase," *Appl. Environ. Microbiol.* 65(1): 143 (1999). The production of these compounds was reflected in the redox and carbon balance although the relationship was not elaborated upon.

The importance of reducing glycerol production is exemplified in the process of corn mash fermentation. About 16 billion gallons of corn-based ethanol are produced annually, so even small increases in ethanol yield, such as 5-10%, can translate into an extra billion or so gallons of ethanol over current yields. Industrial corn mash fermentation by *S. cerevisiae* typically results in approximately 5 g/L cells and glycerol yields ranging from 10-12 g/L. See Yang, R. D., et al., "Pilot plant studies of ethanol production from whole ground corn, corn flour, and starch," Fuel Alcohol U.S.A., Feb. 13-16, 1982 (reported glycerol levels to be as high as 7.2% w/w of initial sugar consumed in normal corn mash fermentations or approximately 1.4 g/100 mL using 20% sugar). During anaerobic growth, it has been empirically determined in the literature that about 9-11 mM glycerol are formed per gram of dry cell weight ("DCW"), which is approximately a 1:1 mass ratio of glycerol to DCW (1 gram of glycerol is produced per gram of cells). The reducing power needed to make glycerol is available from the pool of surplus NADH generated from biosynthetic reactions. Based on the biomass and glycerol assumptions above, a minimum of 5 g/L glycerol is formed independent of anaerobic growth, presumably as part of the organisms osmotic stress response. By reducing or eliminating the glycerol yield in the production of ethanol from corn mash, for example, fermentation and re-engineering metabolic processes, increased ethanol yields can be achieved.

Additional benefits may be gained in the production of ethanol from corn. Corn mash is a nutrient rich medium, in some cases containing lipid and protein content that can be >3% of the total fermentation volume. As a result of the energy contained in these components, even higher ethanol yields may be achieved than what is predicted using, for example, pure sugar. The additional increases can come from the metabolism of lipids or amino acids in the corn mash medium. The recombinant cells and methods of the invention enable increasing ethanol yields from biomass fermentation by reducing or modulating glycerol production and regulation.

BRIEF SUMMARY OF THE INVENTION

The invention is generally directed to the reduction or modulation of glycerol production in a host cell through engineering of the host cell to take up extracellular glycerol in the presence of glucose. The recombinant cells and methods of the invention enable cells to accumulate higher intracellular concentrations of glycerol to improve robustness and decrease the requirement to produce it as part of the stress response pathway. In contrast to other efforts to reduce or eliminate cellular glycerol production or to use glycerol as a fermentative substrate, the present invention uses existing glycerol present in fermentation medium to lower cellular glycerol production through glycerol uptake. Engineering of an alternate electron acceptor in the host cell for the regeneration of $NAD^+$ may also be performed.

An aspect of the invention relates to a recombinant microorganism comprising: (a) one or more native and/or heterologous proteins that function to import glycerol into the recombinant microorganism, wherein said one or more native and/or heterologous proteins is activated, upregulated, or overexpressed; and (b) one or more native and/or heterologous enzymes that function in one or more engineered metabolic pathways to convert a carbohydrate source to an alcohol, wherein said one or more native and/or heterologous enzymes is activated, upregulated, overexpressed, or downregulated.

In certain embodiments, the recombinant microorganism produces less glycerol than a control recombinant microorganism without activation, upregulation, or overexpression of said one or more native and/or heterologous proteins that function to import glycerol.

In some embodiments, the one or more native and/or heterologous proteins that function to import glycerol is STL1. In certain embodiments, the STL1 is derived from *S. cerevisiae*. In some embodiments, the carbohydrate source is biomass.

In some aspects of the invention, the recombinant microorganism further comprises one or more native and/or heterologous proteins that function to export glycerol from the microorganism, wherein said one or more native and/or heterologous enzymes that function to export glycerol is activated, upregulated, or downregulated. In certain embodiments, the heterologous proteins that function to export glycerol from the microorganism are deleted. In some embodiments, the one or more native and/or heterologous proteins that function to export glycerol from the microorganism is FPS1. In certain embodiments, the activated or upregulated native and/or heterologous protein that functions to export glycerol from the microorganism is a constitutively active FPS1 (fps1-1).

In some aspects of the invention, the recombinant microorganism further comprises a deletion or downregulation of one or more native enzymes that function to produce glycerol and/or regulate glycerol synthesis. In certain embodiments, the one or more native enzymes that function to produce glycerol is encoded by a gpd1 polynucleotide, a gpd2 polynucleotide, or both a gpd1 polynucleotide and a gpd2 polynucleotide. In some embodiments, the recombinant microorganism further comprises a native and/or heterologous gpd1 polynucleotide operably linked to a native gpd2 promoter polynucleotide. In certain embodiments, the one or more native enzymes that function to produce glycerol is encoded by a gpp1 polynucleotide, a gpp2 polynucleotide, or both a gpp1 polynucleotide and a gpp2 polynucleotide.

In certain aspects of the invention, the one or more engineered metabolic pathways comprise conversion of acetyl-CoA to an alcohol. In some embodiments, the acetyl-CoA is converted to acetaldehyde by an acetaldehyde dehydrogenase, and the acetaldehyde is converted to an alcohol by an alcohol dehydrogenase. In certain embodiments, the acetyl-CoA is converted to an alcohol by a bifunctional acetaldehyde/alcohol dehydrogenase. In some embodiments, the acetaldehyde dehydrogenase, alcohol dehydrogenase, or bifunctional acetaldehyde/alcohol dehydrogenase is of prokaryotic or eukaryotic origin. In certain embodiments, the acetaldehyde dehydrogenase is from *C. phytofermentans*. In some embodiments, the bifunctional acetaldehyde/alcohol dehydrogenase is from an *Escherichia*, a *Clostridia*, a *Chlamydomonas*, a *Piromyces*, or a *Bifidobacteria* species. In certain embodiments, the bifunctional acetaldehyde/alcohol dehydrogenase is from *Escherichia coli*, *Clostridium phytofermentans*, *Chlamydomonas reinhardtii*, *Piromyces* sp. E2, or *Bifidobacterium adolescentis*. In some embodiments, the bifunctional acetaldehyde/alcohol dehydrogenase is from a *Bifidobacterium adolescentis* or *Piromyces* sp. E2.

In some aspects of the invention, the one or more engineered metabolic pathways comprise conversion of pyruvate to acetyl-CoA and formate. In certain embodiments, the pyruvate is converted to acetyl-CoA and formate by a pyruvate formate lyase (PFL). In some embodiments, the PFL is of prokaryotic or eukaryotic origin. In certain embodiments, the PFL is from one or more of a *Bifidobacteria*, an *Escherichia*, a *Thermoanaerobacter*, a *Clostridia*, a *Streptococcus*, a *Lactobacillus*, a *Chlamydomonas*, a *Piromyces*, a *Neocallimastix*, or a *Bacillus* species. In some embodiments, the PFL is from one or more of a *Bacillus licheniformis*, a *Streptococcus thermophilus*, a *Lactobacillus plantarum*, a *Lactobacillus casei*, a *Bifidobacterium adolescentis*, a *Clostridium cellulolyticum*, an *Escherichia coli*, a *Chlamydomonas reinhardtii* POA, a *Piromyces* sp. E2, or a *Neocallimastix frontalis*. In some embodiments, the PFL is from a *Bifidobacterium adolescentis*. In some embodiments, the recombinant microorganism overexpresses a PflA and/or PflB.

In certain aspects of the invention, the one or more engineered metabolic pathways is the pentose phosphate pathway (PPP). In some embodiments, the one or more engineered metabolic pathways comprises the conversion of D-xylulose 5-phosphate to D-glyceraldehyde 3-phosphate or the conversion of D-fructose 6-phosphate to D-erythrose 4-phosphate. In certain embodiments, the D-xylulose 5-phosphate is converted to D-glyceraldehyde 3-phosphate by a phosphoketolase. In some embodiments, the phosphoketolase is a single-specificity phosphokelotase. In certain embodiments, the D-fructose 6-phosphate is converted to D-erythrose 4-phosphate by a phosphoketolase. In certain embodiments, the phosphoketolase is a dual-specificity phosphokelotase.

In certain aspects of the invention, the one or more engineered metabolic pathways comprises the conversion of acetate to acetyl-CoA. In some embodiments, the acetate is converted to acetyl-P by an acetate kinase, and wherein acetyl-P is converted to acetyl-CoA by a phosphotransacetylase. In certain embodiments, the acetate is converted to acetyl-CoA by an acetyl-CoA synthetase.

In some aspects of the invention, the one or more engineered metabolic pathways comprises one or more native and/or heterologous enzymes that encodes a saccharolytic enzyme. In certain embodiments, the saccharolytic enzyme is selected from the group consisting of amylases, cellulases, hemicellulases, cellulolytic and amylolytic accessory enzymes, inulinases, levanases, and pentose sugar utilizing enzymes. In some embodiments, the cellulase is xylanase. In certain embodiments, the saccharolytic enzyme is from a microorganism selected from the group consisting of *H.* *grisea*, *T. aurantiacus*, *T. emersonii*, *T. reesei*, *C. lacteus*, *C. formosanus*, *N. takasagoensis*, *C. acinaciformis*, *M. darwinensis*, *N. walkeri*, *S. fibuligera*, *C. lucknowense R. speratus*, *Thermobfida fusca*, *Clostridum thermocellum*, *Clostridium cellulolyticum*, *Clostridum josui*, *Bacillus pumilis*, *Cellulomonas fimi*, *Saccharophagus degradans*, *Piromyces equii*, *Neocallimastix patricarum*, *Arabidopsis thaliana*, and *S. fibuligera*. In some embodiments, the saccharolytic enzyme is a glucoamylase. In certain embodiments, the glucoamylase is *S. fibuligera* glucoamylase (glu-0111-CO). In some embodiments, the saccharolytic enzyme is a hemicellulase. The hemicellulase can be derived from any number of organisms, including but not limited to a microorganism selected from the group consisting of *Neosartorya fischeri*, *Pyrenophora tritici-repentis*, *Aspergillus niger*, *Aspergillus fumigatus*, *Aspergillus oryzae*, *Trichoderma reesei*, and *Aspergillus Aculeatus*. Additional examples of hemicellulases that can be used in the present invention are described in co-owned International Application No. PCT/US2014/026499 filed Mar. 13, 2014, which is incorporated by reference in its entirety herein.

In certain aspects of the invention, the microorganism further comprises one or more native and/or heterologous enzymes that function in one or more engineered metabolic pathways to convert xylose to xylulose-5-phosphate and/or arabinose to xylulose-5-phosphate, wherein said one or more native and/or heterologous enzymes is activated, upregulated or downregulated. In some embodiments, the one or more native and/or heterologous enzymes that function to convert xylose to xylulose-5-phosphate is xylose isomerase. In certain embodiments, the one or more native and/or heterologous enzymes that function to convert arabinose to xylulose-5-phosphate is selected from the group consisting of arabinose isomerase, ribulokinase, and ribulose 5-phosphate epimerase.

In some embodiments, one or more engineered metabolic pathways comprises the conversion of trehalose to acetyl-CoA. In certain embodiments, the one or more native and/or heterologous enzymes functions to convert trehalose to glucose.

In certain aspects of the invention, the alcohol is ethanol or isopropanol. In some embodiments, the microorganism produces ethanol. In certain embodiments, the microorganism produces isopropanol.

In some aspects of the invention, the activation, upregulation, or overexpression of one or more native and/or heterologous proteins that function to import glycerol into the recombinant microorganism increases intracellular glycerol concentration. In certain embodiments, the recombinant microorganism increases intracellular glycerol by at least about 0.01 to 10 fold glycerol than is present in a recombinant microorganism without activation, upregulation, or overexpression of one or more native and/or heterologous proteins that function to import glycerol. In some embodiments, the recombinant microorganism increases intracellular glycerol by at least about 0.05 to 5 fold glycerol than is present in a recombinant microorganism without activation, upregulation, or overexpression of one or more native and/or heterologous proteins that function to import glycerol. In certain embodiments, the recombinant microorganism increases intracellular glycerol by at least about 0.1 to 2 fold glycerol than is present in a recombinant microorganism without activation, upregulation, or overexpression of one or more native and/or heterologous proteins that function to import glycerol.

In some embodiments, the recombinant microorganism increases intracellular glycerol by: (a) at least about 0.01- fold more intracellular glycerol than is present in a recombinant microorganism without activation, upregulation, or overexpression of one or more native and/or heterologous proteins that function to import glycerol; (b) at least about 0.05-fold more intracellular glycerol than is present in a recombinant microorganism without activation, upregulation, or overexpression of one or more native and/or heterologous proteins that function to import glycerol; (c) at least about 0.1-fold more intracellular glycerol than is present in a recombinant microorganism without activation, upregulation, or overexpression of one or more native and/or heterologous proteins that function to import glycerol; (d) at least about 0.2-fold more intracellular glycerol than is present in a recombinant microorganism without activation, upregulation, or overexpression of one or more native and/or heterologous proteins that function to import glycerol; (e) at least about 0.3-fold more intracellular glycerol than is present in a recombinant microorganism without activation, upregulation, or overexpression of one or more native and/or heterologous proteins that function to import glycerol; (f) at least about 0.4-fold more intracellular glycerol than is present in a recombinant microorganism without activation, upregulation, or overexpression of one or more native and/or heterologous proteins that function to import glycerol; (g) at least about 0.5-fold more intracellular glycerol than is present in a recombinant microorganism without activation, upregulation, or overexpression of one or more native and/or heterologous proteins that function to import glycerol; (h) at least about 0.6-fold more intracellular glycerol than is present in a recombinant microorganism without activation, upregulation, or overexpression of one or more native and/or heterologous proteins that function to import glycerol; (i) at least about 0.7-fold more intracellular glycerol than is present in a recombinant microorganism without activation, upregulation, or overexpression of one or more native and/or heterologous proteins that function to import glycerol; (j) at least about 0.8-fold more intracellular glycerol than is present in a recombinant microorganism without activation, upregulation, or overexpression of one or more native and/or heterologous proteins that function to import glycerol; (k) at least about 0.9-fold more intracellular glycerol than is present in a recombinant microorganism without activation, upregulation, or overexpression of one or more native and/or heterologous proteins that function to import glycerol; (l) at least about 1.0-fold more intracellular glycerol than is present in a recombinant microorganism without activation, upregulation, or overexpression of one or more native and/or heterologous proteins that function to import glycerol; (m) at least about 1.1-fold more intracellular glycerol than is present in a recombinant microorganism without activation, upregulation, or overexpression of one or more native and/or heterologous proteins that function to import glycerol; (n) at least about 1.2-fold more intracellular glycerol than is present in a recombinant microorganism without activation, upregulation, or overexpression of one or more native and/or heterologous proteins that function to import glycerol; (o) at least about 1.3-fold more intracellular glycerol than is present in a recombinant microorganism without activation, upregulation, or overexpression of one or more native and/or heterologous proteins that function to import glycerol; (p) at least about 1.4-fold more intracellular glycerol than is present in a recombinant microorganism without activation, upregulation, or overexpression of one or more native and/or heterologous proteins that function to import glycerol; (q) at least about 1.5-fold more intracellular glycerol than is present in a recombinant microorganism without activation, upregulation, or overexpression of one or more native and/or heterologous proteins that function to import glycerol; (r) at least about 1.6-fold more intracellular glycerol than is present in a recombinant microorganism without activation, upregulation, or overexpression of one or more native and/or heterologous proteins that function to import glycerol; (s) at least about 1.7-fold more intracellular glycerol than is present in a recombinant microorganism without activation, upregulation, or overexpression of one or more native and/or heterologous proteins that function to import glycerol; (t) at least about 1.8-fold more intracellular glycerol than is present in a recombinant microorganism without activation, upregulation, or overexpression of one or more native and/or heterologous proteins that function to import glycerol; (u) at least about 1.9-fold more intracellular glycerol than is present in a recombinant microorganism without activation, upregulation, or overexpression of one or more native and/or heterologous proteins that function to import glycerol; (v) at least about 2.0-fold more intracellular glycerol than is present in a recombinant microorganism without activation, upregulation, or overexpression of one or more native and/or heterologous proteins that function to import glycerol; (w) at least about 3.0-fold more intracellular glycerol than is present in a recombinant microorganism without activation, upregulation, or overexpression of one or more native and/or heterologous proteins that function to import glycerol; (x) at least about 4.0-fold more intracellular glycerol than is present in a recombinant microorganism without activation, upregulation, or overexpression of one or more native and/or heterologous proteins that function to import glycerol; (y) at least about 5.0-fold more intracellular glycerol than is present in a recombinant microorganism without activation, upregulation, or overexpression of one or more native and/or heterologous proteins that function to import glycerol; (z) at least about 6.0-fold more intracellular glycerol than is present in a recombinant microorganism without activation, upregulation, or overexpression of one or more native and/or heterologous proteins that function to import glycerol; (aa) at least about 7.0-fold more intracellular glycerol than is present in a recombinant microorganism without activation, upregulation, or overexpression of one or more native and/or heterologous proteins that function to import glycerol; (bb) at least about 8.0-fold more intracellular glycerol than is present in a recombinant microorganism without activation, upregulation, or overexpression of one or more native and/or heterologous proteins that function to import glycerol; (cc) at least about 9.0-fold more intracellular glycerol than is present in a recombinant microorganism without activation, upregulation, or overexpression of one or more native and/or heterologous proteins that function to import glycerol; or (dd) at least about 10.0-fold more intracellular glycerol than is present in a recombinant microorganism without activation, upregulation, or overexpression of one or more native and/or heterologous proteins that function to import glycerol.

In certain embodiments, the recombinant microorganism increases intracellular glycerol by: by: (a) at least about 0.05-fold more intracellular glycerol than is present in a recombinant microorganism without activation, upregulation, or overexpression of one or more native and/or heterologous proteins that function to import glycerol; (b) at least about 0.1-fold more intracellular glycerol than is present in a recombinant microorganism without activation, upregulation, or overexpression of one or more native and/or heterologous proteins that function to import glycerol; (c) at least about 0.5-fold more intracellular glycerol than is present in a recombinant microorganism without activation, upregulation, or overexpression of one or more native and/or heterologous proteins that function to import glycerol; (d) at least about 1.0-fold more intracellular glycerol than is present in a recombinant microorganism without activation, upregulation, or overexpression of one or more native and/or heterologous proteins that function to import glycerol; (e) at least about 1.5-fold more intracellular glycerol than is present in a recombinant microorganism without activation, upregulation, or overexpression of one or more native and/or heterologous proteins that function to import glycerol; or (f) at least about 1.7-fold more intracellular glycerol than is present in a recombinant microorganism without activation, upregulation, or overexpression of one or more native and/or heterologous proteins that function to import glycerol.

In certain embodiments, the activation, upregulation, or overexpression of one or more native and/or heterologous proteins that function to import glycerol into the recombinant microorganism reduces glycerol formation. In certain embodiments, the recombinant microorganism reduces glycerol formation by at least about 1% to 100% of the glycerol produced by a recombinant microorganism without activation, upregulation, or overexpression of one or more native and/or heterologous proteins that function to import glycerol. In some embodiments, the recombinant microorganism reduces glycerol formation by at least about 10% to 90% of the glycerol produced by a recombinant microorganism without activation, upregulation, or overexpression of one or more native and/or heterologous proteins that function to import glycerol. In some embodiments, the recombinant microorganism reduces glycerol formation by at least about 20% to 80% of the glycerol produced by a recombinant microorganism without activation, upregulation, or overexpression of one or more native and/or heterologous proteins that function to import glycerol. In some embodiments, the recombinant microorganism reduces glycerol formation by at least about 30% to 60% of the glycerol produced by a recombinant microorganism without activation, upregulation, or overexpression of one or more native and/or heterologous proteins that function to import glycerol. In some embodiments, the recombinant microorganism reduces glycerol formation by at least about 40% to 50% of the glycerol produced by a recombinant microorganism without activation, upregulation, or overexpression of one or more native and/or heterologous proteins that function to import glycerol.

In some embodiments, the recombinant microorganism reduces glycerol formation by: (a) more than about 1% of the glycerol produced by a recombinant microorganism without activation, upregulation, or overexpression of one or more native and/or heterologous proteins that function to import glycerol; (b) more than about 5% of the glycerol produced by a recombinant microorganism without activation, upregulation, or overexpression of one or more native and/or heterologous proteins that function to import glycerol; (c) more than about 10% of the glycerol produced by a recombinant microorganism without activation, upregulation, or overexpression of one or more native and/or heterologous proteins that function to import glycerol; (d) more than about 15% of the glycerol produced by a recombinant microorganism without activation, upregulation, or overexpression of one or more native and/or heterologous proteins that function to import glycerol; (e) more than about 20% of the glycerol produced by a recombinant microorganism without activation, upregulation, or overexpression of one or more native and/or heterologous proteins that function to import glycerol; (f) more than about 25% of the glycerol produced by a recombinant microorganism without activation, upregulation, or overexpression of one or more native and/or heterologous proteins that function to import glycerol; (g) more than about 30% of the glycerol produced by a recombinant microorganism without activation, upregulation, or overexpression of one or more native and/or heterologous proteins that function to import glycerol; (h) more than about 35% of the glycerol produced by a recombinant microorganism without activation, upregulation, or overexpression of one or more native and/or heterologous proteins that function to import glycerol; (i) more than about 40% of the glycerol produced by a recombinant microorganism without activation, upregulation, or overexpression of one or more native and/or heterologous proteins that function to import glycerol; (j) more than about 45% of the glycerol produced by a recombinant microorganism without activation, upregulation, or overexpression of one or more native and/or heterologous proteins that function to import glycerol; (k) more than about 50% of the glycerol produced by a recombinant microorganism without activation, upregulation, or overexpression of one or more native and/or heterologous proteins that function to import glycerol; (l) more than about 55% of the glycerol produced by a recombinant microorganism without activation, upregulation, or overexpression of one or more native and/or heterologous proteins that function to import glycerol; (m) more than about 60% of the glycerol produced by a recombinant microorganism without activation, upregulation, or overexpression of one or more native and/or heterologous proteins that function to import glycerol; (n) more than about 65% of the glycerol produced by a recombinant microorganism without activation, upregulation, or overexpression of one or more native and/or heterologous proteins that function to import glycerol; (o) more than about 70% of the glycerol produced by a recombinant microorganism without activation, upregulation, or overexpression of one or more native and/or heterologous proteins that function to import glycerol; (p) more than about 75% of the glycerol produced by a recombinant microorganism without activation, upregulation, or overexpression of one or more native and/or heterologous proteins that function to import glycerol; (q) more than about 80% of the glycerol produced by a recombinant microorganism without activation, upregulation, or overexpression of one or more native and/or heterologous proteins that function to import glycerol; (r) more than about 85% of the glycerol produced by a recombinant microorganism without activation, upregulation, or overexpression of one or more native and/or heterologous proteins that function to import glycerol; (s) more than about 90% of the glycerol produced by a recombinant microorganism without activation, upregulation, or overexpression of one or more native and/or heterologous proteins that function to import glycerol; (t) more than about 95% of the glycerol produced by a recombinant microorganism without activation, upregulation, or overexpression of one or more native and/or heterologous proteins that function to import glycerol; or (u) more than about 100% of the glycerol produced by a recombinant microorganism without activation, upregulation, or overexpression of one or more native and/or heterologous proteins that function to import glycerol.

In some embodiments, the recombinant microorganism reduces glycerol formation by: (a) more than about 5% of the glycerol produced by a recombinant microorganism without activation, upregulation, or overexpression of one or more native and/or heterologous proteins that function to import glycerol; (b) more than about 10% of the glycerol produced by a recombinant microorganism without activation, upregulation, or overexpression of one or more native and/or heterologous proteins that function to import glycerol; (c) more than about 15% of the glycerol produced by a recombinant microorganism without activation, upregulation, or overexpression of one or more native and/or heterologous proteins that function to import glycerol; (d) more than about 20% of the glycerol produced by a recombinant microorganism without activation, upregulation, or overexpression of one or more native and/or heterologous proteins that function to import glycerol; or (e) more than about 30% of the glycerol produced by a recombinant microorganism without activation, upregulation, or overexpression of one or more native and/or heterologous proteins that function to import glycerol.

In some embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism reduces glycerol formation.

In certain embodiments, the one or more engineered metabolic pathways comprises conversion of pyruvate to acetyl-CoA and formate and the recombinant microorganism reduces glycerol formation by at least about 1% to 100% of the glycerol produced by a recombinant microorganism without activation, upregulation, or overexpression of one or more native and/or heterologous proteins that function to import glycerol. In some embodiments, the one or more engineered metabolic pathways comprises conversion of pyruvate to acetyl-CoA and formate and the recombinant microorganism reduces glycerol formation by at least about 10% to 90% of the glycerol produced by a recombinant microorganism without activation, upregulation, or overexpression of one or more native and/or heterologous proteins that function to import glycerol. In some embodiments, the one or more engineered metabolic pathways comprises conversion of pyruvate to acetyl-CoA and formate and the recombinant microorganism reduces glycerol formation by at least about 20% to 80% of the glycerol produced by a recombinant microorganism without activation, upregulation, or overexpression of one or more native and/or heterologous proteins that function to import glycerol. In some embodiments, the one or more engineered metabolic pathways comprises conversion of pyruvate to acetyl-CoA and formate and the recombinant microorganism reduces glycerol formation by at least about 30% to 60% of the glycerol produced by a recombinant microorganism without activation, upregulation, or overexpression of one or more native and/or heterologous proteins that function to import glycerol. In some embodiments, the one or more engineered metabolic pathways comprises conversion of pyruvate to acetyl-CoA and formate and the recombinant microorganism reduces glycerol formation by at least about 40% to 50% of the glycerol produced by a recombinant microorganism without activation, upregulation, or overexpression of one or more native and/or heterologous proteins that function to import glycerol.

In some embodiments, the one or more engineered metabolic pathways comprises conversion of pyruvate to acetyl-CoA and formate and the recombinant microorganism reduces glycerol formation by: (a) more than about 1% of the glycerol produced by a recombinant microorganism without activation, upregulation, or overexpression of one or more native and/or heterologous proteins that function to import glycerol; (b) more than about 5% of the glycerol produced by a recombinant microorganism without activation, upregulation, or overexpression of one or more native and/or heterologous proteins that function to import glycerol; (c) more than about 10% of the glycerol produced by a recombinant microorganism without activation, upregulation, or overexpression of one or more native and/or heterologous proteins that function to import glycerol; (d) more than about 15% of the glycerol produced by a recombinant microorganism without activation, upregulation, or overexpression of one or more native and/or heterologous proteins that function to import glycerol; (e) more than about 20% of the glycerol produced by a recombinant microorganism without activation, upregulation, or overexpression of one or more native and/or heterologous proteins that function to import glycerol; (f) more than about 25% of the glycerol produced by a recombinant microorganism without activation, upregulation, or overexpression of one or more native and/or heterologous proteins that function to import glycerol; (g) more than about 30% of the glycerol produced by a recombinant microorganism without activation, upregulation, or overexpression of one or more native and/or heterologous proteins that function to import glycerol; (h) more than about 35% of the glycerol produced by a recombinant microorganism without activation, upregulation, or overexpression of one or more native and/or heterologous proteins that function to import glycerol; (i) more than about 40% of the glycerol produced by a recombinant microorganism without activation, upregulation, or overexpression of one or more native and/or heterologous proteins that function to import glycerol; (j) more than about 45% of the glycerol produced by a recombinant microorganism without activation, upregulation, or overexpression of one or more native and/or heterologous proteins that function to import glycerol; (k) more than about 50% of the glycerol produced by a recombinant microorganism without activation, upregulation, or overexpression of one or more native and/or heterologous proteins that function to import glycerol; (l) more than about 55% of the glycerol produced by a recombinant microorganism without activation, upregulation, or overexpression of one or more native and/or heterologous proteins that function to import glycerol; (m) more than about 60% of the glycerol produced by a recombinant microorganism without activation, upregulation, or overexpression of one or more native and/or heterologous proteins that function to import glycerol; (n) more than about 65% of the glycerol produced by a recombinant microorganism without activation, upregulation, or overexpression of one or more native and/or heterologous proteins that function to import glycerol; (o) more than about 70% of the glycerol produced by a recombinant microorganism without activation, upregulation, or overexpression of one or more native and/or heterologous proteins that function to import glycerol; (p) more than about 75% of the glycerol produced by a recombinant microorganism without activation, upregulation, or overexpression of one or more native and/or heterologous proteins that function to import glycerol; (q) more than about 80% of the glycerol produced by a recombinant microorganism without activation, upregulation, or overexpression of one or more native and/or heterologous proteins that function to import glycerol; (r) more than about 85% of the glycerol produced by a recombinant microorganism without activation, upregulation, or overexpression of one or more native and/or heterologous proteins that function to import glycerol; (s) more than about 90% of the glycerol produced by a recombinant microorganism without activation, upregulation, or overexpression of one or more native and/or heterologous proteins that function to import glycerol; (t) more than about 95% of the glycerol produced by a recombinant microorganism without activation, upregulation, or overexpression of one or more native and/or heterologous proteins that function to import glycerol; or (u) more than about 100% of the glycerol produced by a recombinant microorganism without activation, upregulation, or overexpression of one or more native and/or heterologous proteins that function to import glycerol.

In some embodiments, the one or more engineered metabolic pathways comprises conversion of pyruvate to acetyl-CoA and formate and the recombinant microorganism reduces glycerol formation by: (a) more than about 5% of the glycerol produced by a recombinant microorganism without activation, upregulation, or overexpression of one or more native and/or heterologous proteins that function to import glycerol; (b) more than about 10% of the glycerol produced by a recombinant microorganism without activation, upregulation, or overexpression of one or more native and/or heterologous proteins that function to import glycerol; (c) more than about 15% of the glycerol produced by a recombinant microorganism without activation, upregulation, or overexpression of one or more native and/or heterologous proteins that function to import glycerol; (d) more than about 20% of the glycerol produced by a recombinant microorganism without activation, upregulation, or overexpression of one or more native and/or heterologous proteins that function to import glycerol; (e) more than about 25% of the glycerol produced by a recombinant microorganism without activation, upregulation, or overexpression of one or more native and/or heterologous proteins that function to import glycerol; or (f) more than about 30% of the glycerol produced by a recombinant microorganism without activation, upregulation, or overexpression of one or more native and/or heterologous proteins that function to import glycerol.

In certain embodiments, the one or more engineered metabolic pathways of the recombinant microorganism comprises one or more native and/or heterologous enzymes that encodes a saccharolytic enzyme and the activation, upregulation, or overexpression of one or more native and/or heterologous proteins that function to import glycerol into the recombinant microorganism reduces glycerol formation.

In certain embodiments, the one or more engineered metabolic pathways of the recombinant microorganism comprises one or more native and/or heterologous enzymes that encodes a saccharolytic enzyme and the recombinant microorganism reduces glycerol formation by at least about 1% to 100% of the glycerol produced by a recombinant microorganism without activation, upregulation, or overexpression of one or more native and/or heterologous proteins that function to import glycerol. In some embodiments, the one or more engineered metabolic pathways of the recombinant microorganism comprises one or more native and/or heterologous enzymes that encodes a saccharolytic enzyme and the recombinant microorganism reduces glycerol formation by at least about 10% to 90% of the glycerol produced by a recombinant microorganism without activation, upregulation, or overexpression of one or more native and/or heterologous proteins that function to import glycerol. In some embodiments, the one or more engineered metabolic pathways of the recombinant microorganism comprises one or more native and/or heterologous enzymes that encodes a saccharolytic enzyme and the recombinant microorganism reduces glycerol formation by at least about 20% to 80% of the glycerol produced by a recombinant microorganism without activation, upregulation, or overexpression of one or more native and/or heterologous proteins that function to import glycerol. In some embodiments, the one or more engineered metabolic pathways of the recombinant microorganism comprises one or more native and/or heterologous enzymes that encodes a saccharolytic enzyme and the recombinant microorganism reduces glycerol formation by at least about 30% to 60% of the glycerol produced by a recombinant microorganism without activation, upregulation, or overexpression of one or more native and/or heterologous proteins that function to import glycerol. In some embodiments, the one or more engineered metabolic pathways of the recombinant microorganism comprises one or more native and/or heterologous enzymes that encodes a saccharolytic enzyme and the recombinant microorganism reduces glycerol formation by at least about 40% to 50% of the glycerol produced by a recombinant microorganism without activation, upregulation, or overexpression of one or more native and/or heterologous proteins that function to import glycerol.

In some embodiments, the one or more engineered metabolic pathways of the recombinant microorganism comprises one or more native and/or heterologous enzymes that encodes a saccharolytic enzyme and the recombinant microorganism reduces glycerol formation by: (a) more than about 1% of the glycerol produced by a recombinant microorganism without activation, upregulation, or overexpression of one or more native and/or heterologous proteins that function to import glycerol; (b) more than about 5% of the glycerol produced by a recombinant microorganism without activation, upregulation, or overexpression of one or more native and/or heterologous proteins that function to import glycerol; (c) more than about 10% of the glycerol produced by a recombinant microorganism without activation, upregulation, or overexpression of one or more native and/or heterologous proteins that function to import glycerol; (d) more than about 15% of the glycerol produced by a recombinant microorganism without activation, upregulation, or overexpression of one or more native and/or heterologous proteins that function to import glycerol; (e) more than about 20% of the glycerol produced by a recombinant microorganism without activation, upregulation, or overexpression of one or more native and/or heterologous proteins that function to import glycerol; (f) more than about 25% of the glycerol produced by a recombinant microorganism without activation, upregulation, or overexpression of one or more native and/or heterologous proteins that function to import glycerol; (g) more than about 30% of the glycerol produced by a recombinant microorganism without activation, upregulation, or overexpression of one or more native and/or heterologous proteins that function to import glycerol; (h) more than about 35% of the glycerol produced by a recombinant microorganism without activation, upregulation, or overexpression of one or more native and/or heterologous proteins that function to import glycerol; (i) more than about 40% of the glycerol produced by a recombinant microorganism without activation, upregulation, or overexpression of one or more native and/or heterologous proteins that function to import glycerol; (j) more than about 45% of the glycerol produced by a recombinant microorganism without activation, upregulation, or overexpression of one or more native and/or heterologous proteins that function to import glycerol; (k) more than about 50% of the glycerol produced by a recombinant microorganism without activation, upregulation, or overexpression of one or more native and/or heterologous proteins that function to import glycerol; (l) more than about 55% of the glycerol produced by a recombinant microorganism without activation, upregulation, or overexpression of one or more native and/or heterologous proteins that function to import glycerol; (m) more than about 60% of the glycerol produced by a recombinant microorganism without activation, upregulation, or overexpression of one or more native and/or heterologous proteins that function to import glycerol; (n) more than about 65% of the glycerol produced by a recombinant microorganism without activation, upregulation, or overexpression of one or more native and/or heterologous proteins that function to import glycerol; (o) more than about 70% of the glycerol produced by a recombinant microorganism without activation, upregulation, or overexpression of one or more native and/or heterologous proteins that function to import glycerol; (p) more than about 75% of the glycerol produced by a recombinant microorganism without activation, upregulation, or overexpression of one or more native and/or heterologous proteins that function to import glycerol; (q) more than about 80% of the glycerol produced by a recombinant microorganism without activation, upregulation, or overexpression of one or more native and/or heterologous proteins that function to import glycerol; (r) more than about 85% of the glycerol produced by a recombinant microorganism without activation, upregulation, or overexpression of one or more native and/or heterologous proteins that function to import glycerol; (s) more than about 90% of the glycerol produced by a recombinant microorganism without activation, upregulation, or overexpression of one or more native and/or heterologous proteins that function to import glycerol; (t) more than about 95% of the glycerol produced by a recombinant microorganism without activation, upregulation, or overexpression of one or more native and/or heterologous proteins that function to import glycerol; or (u) more than about 100% of the glycerol produced by a recombinant microorganism without activation, upregulation, or overexpression of one or more native and/or heterologous proteins that function to import glycerol.

In some embodiments, the one or more engineered metabolic pathways of the recombinant microorganism comprises one or more native and/or heterologous enzymes that encodes a saccharolytic enzyme and the recombinant microorganism reduces glycerol formation by: (a) more than about 5% of the glycerol produced by a recombinant microorganism without activation, upregulation, or overexpression of one or more native and/or heterologous proteins that function to import glycerol; (b) more than about 10% of the glycerol produced by a recombinant microorganism without activation, upregulation, or overexpression of one or more native and/or heterologous proteins that function to import glycerol; (c) more than about 15% of the glycerol produced by a recombinant microorganism without activation, upregulation, or overexpression of one or more native and/or heterologous proteins that function to import glycerol; (d) more than about 20% of the glycerol produced by a recombinant microorganism without activation, upregulation, or overexpression of one or more native and/or heterologous proteins that function to import glycerol; (e) more than about 25% of the glycerol produced by a recombinant microorganism without activation, upregulation, or overexpression of one or more native and/or heterologous proteins that function to import glycerol; or (f) more than about 30% of the glycerol produced by a recombinant microorganism without activation, upregulation, or overexpression of one or more native and/or heterologous proteins that function to import glycerol.

In some aspects of the invention, the activation, upregulation, or overexpression of one or more native and/or heterologous proteins that function to import glycerol into the recombinant microorganism increases ethanol yield.

In some embodiments, the activation, upregulation, or overexpression of one or more native and/or heterologous proteins that function to import glycerol into the recombinant microorganism increases ethanol yield by at least about 0.001-fold to 10-fold than is produced in a recombinant microorganism without activation, upregulation, or overexpression of one or more native and/or heterologous proteins that function to import glycerol. In certain embodiments, the activation, upregulation, or overexpression of one or more native and/or heterologous proteins that function to import glycerol into the recombinant microorganism increases ethanol yield by at least about 0.005-fold to 1.10-fold than is produced in a recombinant microorganism without activation, upregulation, or overexpression of one or more native and/or heterologous proteins that function to import glycerol. In certain embodiments, the activation, upregulation, or overexpression of one or more native and/or heterologous proteins that function to import glycerol into the recombinant microorganism increases ethanol yield by at least about 0.01-fold to 1.05-fold than is produced in a recombinant microorganism without activation, upregulation, or overexpression of one or more native and/or heterologous proteins that function to import glycerol. In some embodiments, the activation, upregulation, or overexpression of one or more native and/or heterologous proteins that function to import glycerol into the recombinant microorganism increases ethanol yield by at least about 0.05-fold to 1.0-fold than is produced in a recombinant microorganism without activation, upregulation, or overexpression of one or more native and/or heterologous proteins that function to import glycerol. In some embodiments, the activation, upregulation, or overexpression of one or more native and/or heterologous proteins that function to import glycerol into the recombinant microorganism increases ethanol yield by at least about 0.1-fold to 0.5-fold than is produced in a recombinant microorganism without activation, upregulation, or overexpression of one or more native and/or heterologous proteins that function to import glycerol.

In certain embodiments, the activation, upregulation, or overexpression of one or more native and/or heterologous proteins that function to import glycerol into the recombinant microorganism increases ethanol yield by: (a) at least about 0.005-fold more than is produced in a recombinant microorganism without activation, upregulation, or overexpression of one or more native and/or heterologous proteins that function to import glycerol; (b) at least about 0.01-fold more than is produced in a recombinant microorganism without activation, upregulation, or overexpression of one or more native and/or heterologous proteins that function to import glycerol; (c) at least about 0.05-fold more than is produced in a recombinant microorganism without activation, upregulation, or overexpression of one or more native and/or heterologous proteins that function to import glycerol; (d) at least about 0.1-fold more than is produced in a recombinant microorganism without activation, upregulation, or overexpression of one or more native and/or heterologous proteins that function to import glycerol; (e) at least about 0.2-fold more than is produced in a recombinant microorganism without activation, upregulation, or overexpression of one or more native and/or heterologous proteins that function to import glycerol; (f) at least about 0.3-fold more than is produced in a recombinant microorganism without activation, upregulation, or overexpression of one or more native and/or heterologous proteins that function to import glycerol; (g) at least about 0.4-fold more than is produced in a recombinant microorganism without activation, upregulation, or overexpression of one or more native and/or heterologous proteins that function to import glycerol; (h) at least about 0.5-fold more than is produced in a recombinant microorganism without activation, upregulation, or overexpression of one or more native and/or heterologous proteins that function to import glycerol; (i) at least about 0.6-fold more than is produced in a recombinant microorganism without activation, upregulation, or overexpression of one or more native and/or heterologous proteins that function to import glycerol; (j) at least about 0.7-fold more than is produced in a recombinant microorganism without activation, upregulation, or overexpression of one or more native and/or heterologous proteins that function to import glycerol; (k) at least about 0.8-fold more than is produced in a recombinant microorganism without activation, upregulation, or overexpression of one or more native and/or heterologous proteins that function to import glycerol; (l) at least about 0.9-fold more than is produced in a recombinant microorganism without activation, upregulation, or overexpression of one or more native and/or heterologous proteins that function to import glycerol; (m) at least about 1.0-fold more than is produced in a recombinant microorganism without activation, upregulation, or overexpression of one or more native and/or heterologous proteins that function to import glycerol; (n) at least about 1.05-fold more than is produced in a recombinant microorganism without activation, upregulation, or overexpression of one or more native and/or heterologous proteins that function to import glycerol; (o) at least about 1.10-fold more than is produced in a recombinant microorganism without activation, upregulation, or overexpression of one or more native and/or heterologous proteins that function to import glycerol; (p) at least about 2-fold more than is produced in a recombinant microorganism without activation, upregulation, or overexpression of one or more native and/or heterologous proteins that function to import glycerol; (q) at least about 5-fold more than is produced in a recombinant microorganism without activation, upregulation, or overexpression of one or more native and/or heterologous proteins that function to import glycerol; or r) at least about 10-fold more than is produced in a recombinant microorganism without activation, upregulation, or overexpression of one or more native and/or heterologous proteins that function to import glycerol.

In certain embodiments, the activation, upregulation, or overexpression of one or more native and/or heterologous proteins that function to import glycerol into the recombinant microorganism increases ethanol yield by: (a) at least about 0.005-fold more than is produced in a recombinant microorganism without activation, upregulation, or overexpression of one or more native and/or heterologous proteins that function to import glycerol; (b) at least about 0.01-fold more than is produced in a recombinant microorganism without activation, upregulation, or overexpression of one or more native and/or heterologous proteins that function to import glycerol; (c) at least about 0.05-fold more than is produced in a recombinant microorganism without activation, upregulation, or overexpression of one or more native and/or heterologous proteins that function to import glycerol; (d) at least about 0.1-fold more than is produced in a recombinant microorganism without activation, upregulation, or overexpression of one or more native and/or heterologous proteins that function to import glycerol; (e) at least about 0.5-fold more than is produced in a recombinant microorganism without activation, upregulation, or overexpression of one or more native and/or heterologous proteins that function to import glycerol; (f) at least about 1.0-fold more than is produced in a recombinant microorganism without activation, upregulation, or overexpression of one or more native and/or heterologous proteins that function to import glycerol; (g) at least about 1.05-fold more than is produced in a recombinant microorganism without activation, upregulation, or overexpression of one or more native and/or heterologous proteins that function to import glycerol; or (h) at least about 1.10-fold more than is produced in a recombinant microorganism without activation, upregulation, or overexpression of one or more native and/or heterologous proteins that function to import glycerol.

In certain embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism increases ethanol yield.

In some embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism increases ethanol yield by at least about 0.001-fold to 10-fold than is produced in a recombinant microorganism without activation, upregulation, or overexpression of one or more native and/or heterologous proteins that function to import glycerol. In certain embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism increases ethanol yield by at least about 0.005-fold to 1.10-fold than is produced in a recombinant microorganism without activation, upregulation, or overexpression of one or more native and/or heterologous proteins that function to import glycerol. In certain embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism increases ethanol yield by at least about 0.01-fold to 1.05-fold than is produced in a recombinant microorganism without activation, upregulation, or overexpression of one or more native and/or heterologous proteins that function to import glycerol. In some embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism increases ethanol yield by at least about 0.05-fold to 1.0-fold than is produced in a recombinant microorganism without activation, upregulation, or overexpression of one or more native and/or heterologous proteins that function to import glycerol. In some embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism increases ethanol yield by at least about 0.1-fold to 0.5-fold than is produced in a recombinant microorganism without activation, upregulation, or overexpression of one or more native and/or heterologous proteins that function to import glycerol.

In certain embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism increases ethanol yield by: (a) at least about 0.005-fold more than is produced in a recombinant microorganism without activation, upregulation, or overexpression of one or more native and/or heterologous proteins that function to import glycerol; (b) at least about 0.01-fold more than is produced in a recombinant microorganism without activation, upregulation, or overexpression of one or more native and/or heterologous proteins that function to import glycerol; (c) at least about 0.05-fold more than is produced in a recombinant microorganism without activation, upregulation, or overexpression of one or more native and/or heterologous proteins that function to import glycerol; (d) at least about 0.1-fold more than is produced in a recombinant microorganism without activation, upregulation, or overexpression of one or more native and/or heterologous proteins that function to import glycerol; (e) at least about 0.2-fold more than is produced in a recombinant microorganism without activation, upregulation, or overexpression of one or more native and/or heterologous proteins that function to import glycerol; (f) at least about 0.3-fold more than is produced in a recombinant microorganism without activation, upregulation, or overexpression of one or more native and/or heterologous proteins that function to import glycerol; (g) at least about 0.4-fold more than is produced in a recombinant microorganism without activation, upregulation, or overexpression of one or more native and/or heterologous proteins that function to import glycerol; (h) at least about 0.5-fold more than is produced in a recombinant microorganism without activation, upregulation, or overexpression of one or more native and/or heterologous proteins that function to import glycerol; (i) at least about 0.6-fold more than is produced in a recombinant microorganism without activation, upregulation, or overexpression of one or more native and/or heterologous proteins that function to import glycerol; (j) at least about 0.7-fold more than is produced in a recombinant microorganism without activation, upregulation, or overexpression of one or more native and/or heterologous proteins that function to import glycerol; (k) at least about 0.8-fold more than is produced in a recombinant microorganism without activation, upregulation, or overexpression of one or more native and/or heterologous proteins that function to import glycerol; (l) at least about 0.9-fold more than is produced in a recombinant microorganism without activation, upregulation, or overexpression of one or more native and/or heterologous proteins that function to import glycerol; (m) at least about 1.0-fold more than is produced in a recombinant microorganism without activation, upregulation, or overexpression of one or more native and/or heterologous proteins that function to import glycerol; (n) at least about 1.05-fold more than is produced in a recombinant microorganism without activation, upregulation, or overexpression of one or more native and/or heterologous proteins that function to import glycerol; (o) at least about 1.10-fold more than is produced in a recombinant microorganism without activation, upregulation, or overexpression of one or more native and/or heterologous proteins that function to import glycerol; (p) at least about 2-fold more than is produced in a recombinant microorganism without activation, upregulation, or overexpression of one or more native and/or heterologous proteins that function to import glycerol; (q) at least about 5-fold more than is produced in a recombinant microorganism without activation, upregulation, or overexpression of one or more native and/or heterologous proteins that function to import glycerol; or r) at least about 10-fold more than is produced in a recombinant microorganism without activation, upregulation, or overexpression of one or more native and/or heterologous proteins that function to import glycerol.

In certain embodiments, the one or more engineered metabolic pathways of the recombinant microorganism comprises conversion of pyruvate to acetyl-CoA and formate and the activation, upregulation, or overexpression of one or more native and/or heterologous proteins that function to import glycerol into the recombinant microorganism increases ethanol yield by: (a) at least about 0.005-fold more than is produced in a recombinant microorganism without activation, upregulation, or overexpression of one or more native and/or heterologous proteins that function to import glycerol; (b) at least about 0.01-fold more than is produced in a recombinant microorganism without activation, upregulation, or overexpression of one or more native and/or heterologous proteins that function to import glycerol; (c) at least about 0.05-fold more than is produced in a recombinant microorganism without activation, upregulation, or overexpression of one or more native and/or heterologous proteins that function to import glycerol; at least about 0.1-fold more than is produced in a recombinant microorganism without activation, upregulation, or overexpression of one or more native and/or heterologous proteins that function to import glycerol; (d) at least about 0.5-fold more than is produced in a recombinant microorganism without activation, upregulation, or overexpression of one or more native and/or heterologous proteins that function to import glycerol; (e) at least about 1.0-fold more than is produced in a recombinant microorganism without activation, upregulation, or overexpression of one or more native and/or heterologous proteins that function to import glycerol; or (f) at least about 1.02-fold more than is produced in a recombinant microorganism without activation, upregulation, or overexpression of one or more native and/or heterologous proteins that function to import glycerol.

In certain embodiments, the activation, upregulation, or overexpression of one or more native and/or heterologous proteins that function to import glycerol into the recombinant microorganism increases ethanol yield by: (a) at least about 0.005-fold more than is produced in a recombinant microorganism without activation, upregulation, or overexpression of one or more native and/or heterologous proteins that function to import glycerol; (b) at least about 0.01-fold more than is produced in a recombinant microorganism without activation, upregulation, or overexpression of one or more native and/or heterologous proteins that function to import glycerol; (c) at least about 0.05-fold more than is produced in a recombinant microorganism without activation, upregulation, or overexpression of one or more native and/or heterologous proteins that function to import glycerol; (d) at least about 0.1-fold more than is produced in a recombinant microorganism without activation, upregulation, or overexpression of one or more native and/or heterologous proteins that function to import glycerol; (e) at least about 0.5-fold more than is produced in a recombinant microorganism without activation, upregulation, or overexpression of one or more native and/or heterologous proteins that function to import glycerol; (f) at least about 1.0-fold more than is produced in a recombinant microorganism without activation, upregulation, or overexpression of one or more native and/or heterologous proteins that function to import glycerol; or (g) at least about 1.02-fold more than is produced in a recombinant microorganism without activation, upregulation, or overexpression of one or more native and/or heterologous proteins that function to import glycerol.

In certain aspects, the recombinant microorganism further comprises one or more native and/or heterologous proteins that function to export glycerol from the microorganism, wherein said one or more native proteins that function to export glycerol is downregulated or deleted and is encoded by fps1.

In some embodiments, the recombinant microorganism further comprises one or more native and/or heterologous proteins that function to export glycerol from the microorganism, wherein said one or more native proteins that function to export glycerol is activated or upregulated and is encoded by a constitutively active FPS1 (fps1-1).

In certain embodiments, the recombinant microorganism further comprises one or more native enzymes that function to produce glycerol, wherein said one or more native enzymes that function to produce glycerol is downregulated or deleted and is encoded by a gpd1 polynucleotide, a gpd2 polynucleotide, or both a gpd1 polynucleotide and a gpd2 polynucleotide. Eukaryotic GPD sequences include: *S. cerevisiae* gpd1 (SEQ ID NOs: 206 and 207) and *S. cerevisiae* gpd2 (SEQ ID NOs: 204 and 205).

In some embodiments, the recombinant microorganism further comprises one or more native enzymes that function to catabolize glycerol. In certain embodiments, the recombinant microorganism overexpresses a glycerol dehydrogenase gene. In certain embodiments, the glycerol dehydrogenase gene encodes a protein having glycerol dehydrogenase activity. Glycerol dehydrogenase includes those enzymes that correspond to Enzyme Commission Number 1.1.1.6. In one embodiment, the glycerol dehydrogenase gene is GCY1 (SEQ ID NOs: 214 and 215).

In some aspects of the invention, the one or more engineered metabolic pathways comprises conversion of acetyl-CoA to an alcohol, and wherein said acetyl-CoA is converted to an alcohol by a bifunctional acetaldehyde/alcohol dehydrogenase. In some embodiments, the one or more engineered metabolic pathways comprises conversion of pyruvate to acetyl-CoA and formate, and wherein said pyruvate is converted to acetyl-CoA and formate by a pyruvate formate lyase (PFL).

In certain embodiments, the one or more engineered metabolic pathway comprises the conversion of D-xylulose 5-phosphate to D-glyceraldehyde 3-phosphate or the conversion of D-fructose 6-phosphate to D-erythrose 4-phosphate, and wherein said conversion of D-xylulose 5-phosphate to D-glyceraldehyde 3-phosphate or the conversion of D-fructose 6-phosphate to D-erythrose 4-phosphate is performed by phosphoketolase. In some embodiments, the one or more engineered metabolic pathways comprises the conversion of acetate to acetyl-CoA, wherein said acetate is converted to acetyl-P by an acetate kinase, and wherein acetyl-P is converted to acetyl-CoA by a phosphotransacetylase. In certain embodiments, the one or more engineered metabolic pathways comprises the conversion of acetate to acetyl-CoA, wherein said acetate is converted to acetyl-CoA by an acetyl-CoA synthetase.

In some aspects of the invention, the one or more engineered metabolic pathways comprises one or more native and/or heterologous enzymes that encodes a saccharolytic enzyme, and wherein said saccharolytic enzyme is glucoamylase.

In some aspects of the invention, the recombinant microorganism further comprises one or more native and/or heterologous enzymes that function in one or more engineered metabolic pathways to convert xylose to xylulose-5-phosphate, and wherein xylose is converted to xylulose-5-phosphate by xylose isomerase. In certain embodiments, the one or more engineered metabolic pathway is the pentose phosphate pathway (PPP).

In some aspects of the invention, the recombinant microorganism further comprises one or more native and/or heterologous enzymes that function in one or more engineered metabolic pathways to convert arabinose to xylulose-5-phosphate, and wherein arabinose is converted to xylulose-5-phosphate by arabinose isomerase, ribulokinase, or ribulose 5-phosphate epimerase.

In some embodiments, the recombinant microorganism further comprises one or more native enzymes that function to produce glycerol, wherein said one or more native enzymes that function to produce glycerol is downregulated or deleted and is encoded by a gpp1 polynucleotide, a gpp2 polynucleotide, or both a gpp1 polynucleotide and a gpp2 polynucleotide.

In certain aspects of the invention, the one or more engineered metabolic pathways comprises the conversion of trehalose to acetyl-CoA, and wherein said one or more native and/or heterologous enzymes functions to convert trehalose to glucose. In some embodiments, the one or more engineered metabolic pathways comprises one or more native and/or heterologous enzymes that encodes a saccharolytic enzyme, and wherein said saccharolytic enzyme is cellulase. In certain embodiments, the one or more engineered metabolic pathways comprises one or more native and/or heterologous enzymes that encodes a saccharolytic enzyme, and wherein said saccharolytic enzyme is xylanase.

In certain aspects of the invention, the recombinant microorganism is a thermophilic or mesophilic bacterium. In some embodiments, the thermophilic or mesophilic bacterium is a species of the genera *Thermoanaerobacterium, Thermoanaerobacter, Clostridium, Geobacillus, Saccharococcus, Paenibacillus, Bacillus, Caldicellulosiruptor, Anaerocellum,* or *Anoxybacillus*. In certain embodiments, the microorganism is a bacterium selected from the group consisting of: *Thermoanaerobacterium thermosulfurigenes, Thermoanaerobacterium aotearoense, Thermoanaerobacterium polysaccharolyticum, Thermoanaerobacterium zeae, Thermoanaerobacterium xylanolyticum, Thermoanaerobacterium saccharolyticum, Thermoanaerobium brockii, Thermoanaerobacterium thermosaccharolyticum, Thermoanaerobacter thermohydrosulfuricus, Thermoanaerobacter ethanolicus, Thermoanaerobacter brocki, Clostridium thermocellum, Clostridium cellulolyticum, Clostridium phytofermentans, Clostridium straminosolvens, Geobacillus thermoglucosidasius, Geobacillus stearothermophilus, Saccharococcus caldoxylosilyticus, Saccharoccus thermophilus, Paenibacillus campinasensis, Bacillus flavothermus, Anoxybacillus kamchatkensis, Anoxybacillus gonensis, Caldicellulosiruptor acetigenus, Caldicellulosiruptor saccharolyticus, Caldicellulosiruptor kristjanssonii, Caldicellulosiruptor owensensis, Caldicellulosiruptor lactoaceticus,* and *Anaerocellum thermophilum*. In certain embodiments, the microorganism is selected from the group consisting of *Clostridium thermocellum,* and *Thermoanaerobacterium saccharolyticum*.

In some embodiments, the recombinant microorganism is a yeast. In certain embodiments, the yeast is selected from the group consisting of *Saccharomyces cerevisiae, Kluyveromyces lactis, Kluyveromyces marxianus, Pichia pastoris, Yarrowia lipolytica, Hansenula polymorpha, Phaffia rhodozyma, Candida utilis, Arxula adeninivorans, Pichia stipitis, Debaryomyces hansenii, Debaryomyces polymor-*

*phus, Schizosaccharomyces pombe, Candida albicans*, and *Schwanniomyces occidentalis*. In some embodiments, the yeast is *Saccharomyces cerevisiae*.

Another aspect of the invention is a method for decreasing cellular-produced glycerol comprising contacting biomass with a recombinant microorganism of the invention. An aspect of the invention is a process for converting biomass to ethanol comprising contacting biomass with a recombinant microorganism of the invention.

Another aspect of the invention is a process for converting biomass to isopropanol comprising contacting biomass with a recombinant microorganism of the invention. In certain embodiments of these methods and processes, the biomass comprises lignocellulosic biomass. In some embodiments, the lignocellulosic biomass is selected from the group consisting of grass, switch grass, cord grass, rye grass, reed canary grass, mixed prairie grass, *miscanthus*, sugar-processing residues, sugarcane bagasse, sugarcane straw, agricultural wastes, rice straw, rice hulls, barley straw, corn cobs, cereal straw, wheat straw, canola straw, oat straw, oat hulls, corn fiber, stover, soybean stover, corn stover, forestry wastes, recycled wood pulp fiber, paper sludge, sawdust, hardwood, softwood, agave, and combinations thereof. In certain embodiments, the biomass is corn mash or corn starch.

In some embodiments of the invention, one of the engineered metabolic pathways comprises (a) conversion of acetyl-CoA to acetoacetyl-CoA; (b) conversion of acetoacetyl-CoA to acetoacetate; (c) conversion of acetoacetate to acetone; and (d) conversion of acetone to isopropanol. In some embodiments, the acetyl-CoA is converted to acetoacetyl-CoA by a thiolase. In certain embodiments, the acetoacetyl-CoA is converted to acetoacetate by a CoA transferase. In some embodiments, the acetoacetate is converted to acetone by an acetoacetate decarboxylase. In certain embodiments, the acetone is converted to isopropanol by an alcohol dehydrogenase. In some embodiments, the alcohol dehydrogenase is a bifunctional acetaldehyde/alcohol dehydrogenase. In certain embodiments, the bifunctional acetaldehyde/alcohol dehydrogenase is of prokaryotic or eukaryotic origin. In some embodiments, the bifunctional acetaldehyde/alcohol dehydrogenase is from an *Escherichia*, a *Clostridia*, a *Chlamydomonas*, a *Piromyces*, or a *Bifidobacteria* species. In certain embodiments, the bifunctional acetaldehyde/alcohol dehydrogenase is from *Escherichia coli, Clostridium phytofermentans, Chlamydomonas reinhardtii, Piromyces* sp. E2, or *Bifidobacterium adolescentis*. In some embodiments, the bifunctional acetaldehyde/alcohol dehydrogenase is from a *Bifidobacterium adolescentis* or *Piromyces* sp. E2. In some embodiments of the invention, the recombinant microorganism is an *S. cerevisiae* of strain PE-2. In certain embodiments, the PE-2 strain comprises a deletion or disruption of one or more endogenous genes selected from the group consisting of GPD1, GPD2, FDH1, FDH2, and any combination thereof. In certain embodiments, the PE-2 strain comprises a deletion or disruption of an aldose reductase gene, e.g., GRE3. In some embodiments, the PE-2 strain overexpresses one or more genes selected from the group consisting of AdhE, PflA, PflB, STL1, GCY1, and DAK1. In some embodiments, the AdhE, PflA, and PflB are from *Bifidobacterium adolescentis*. In some embodiments, the PE-2 strain overexpresses a hemicellulase and/or a gene encoding a protein of the xylose fermentation pathway. In some embodiments, the gene encoding a protein of the xylose fermentation pathway is selected from the group consisting of xylose isomerase (XylA), xylulokinase (XKS1), transketolase (TKL2), transaldolase (TAL1), and any combination thereof. In some embodiments, the xylose isomerase can be any protein that catalyzes the reaction of converting xylose to xylulose, including those enzymes that correspond to Enzyme Commission number 5.3.1.5, and including but not limited to a xylose isomerase from a microorganism selected from *Piromyces* sp. or *B. thetaiotaomicron*. In certain embodiments, the hemicellulase is from a microorganism selected from the group consisting of *H. grisea, T. aurantiacus, T. emersonii, T. reesei, C. lacteus, C. formosanus, N. takasagoensis, C. acinaciformis, M. darwinensis, N. walkeri, S. fibuligera, C. lucknowense R. speratus, Thermobfida fusca, Clostridum thermocellum, Clostridium cellulolyticum, Clostridum josui, Bacillus pumilis, Cellulomonas fimi, Saccharophagus degradans, Piromyces equii, Neocallimastix patricarum, Arabidopsis thaliana*, and *S. fibuligera*. In some embodiments, the hemicellulase is from a microorganism selected from the group consisting of Neosartorya *fischeri, Pyrenophora tritici*-repentis, *Aspergillus niger, Aspergillus fumigatus, Aspergillus oryzae, Trichoderma reesei*, and *Aspergillus Aculeatus*.

BRIEF DESCRIPTION OF THE DRAWINGS/FIGURES

Figure 3:
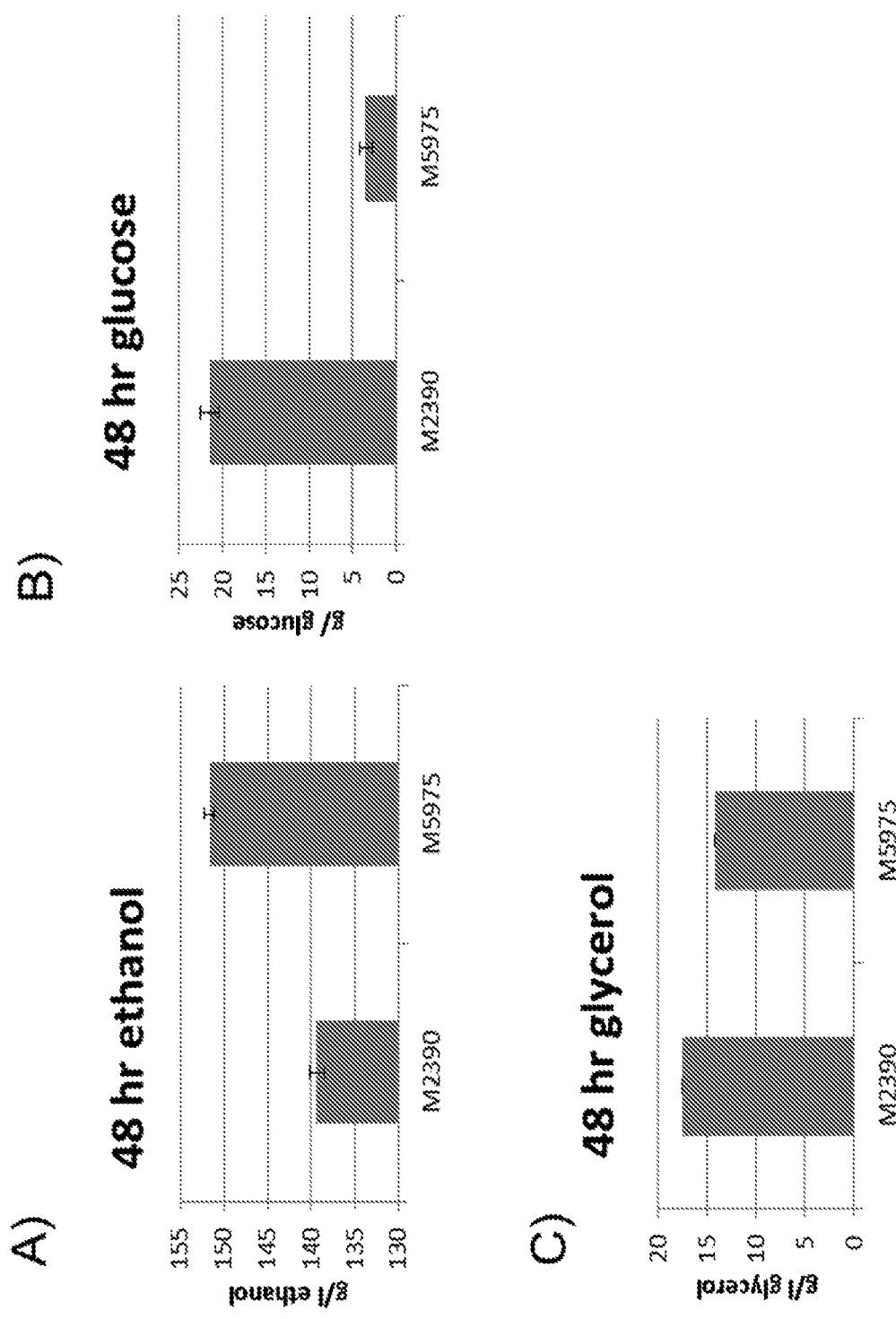

FIGS. 3A, 3B, and 3C depict ethanol, glycerol, and glucose concentrations, respectively, in strains of the invention following fermentation in YMD-300 medium.

Figure 4:
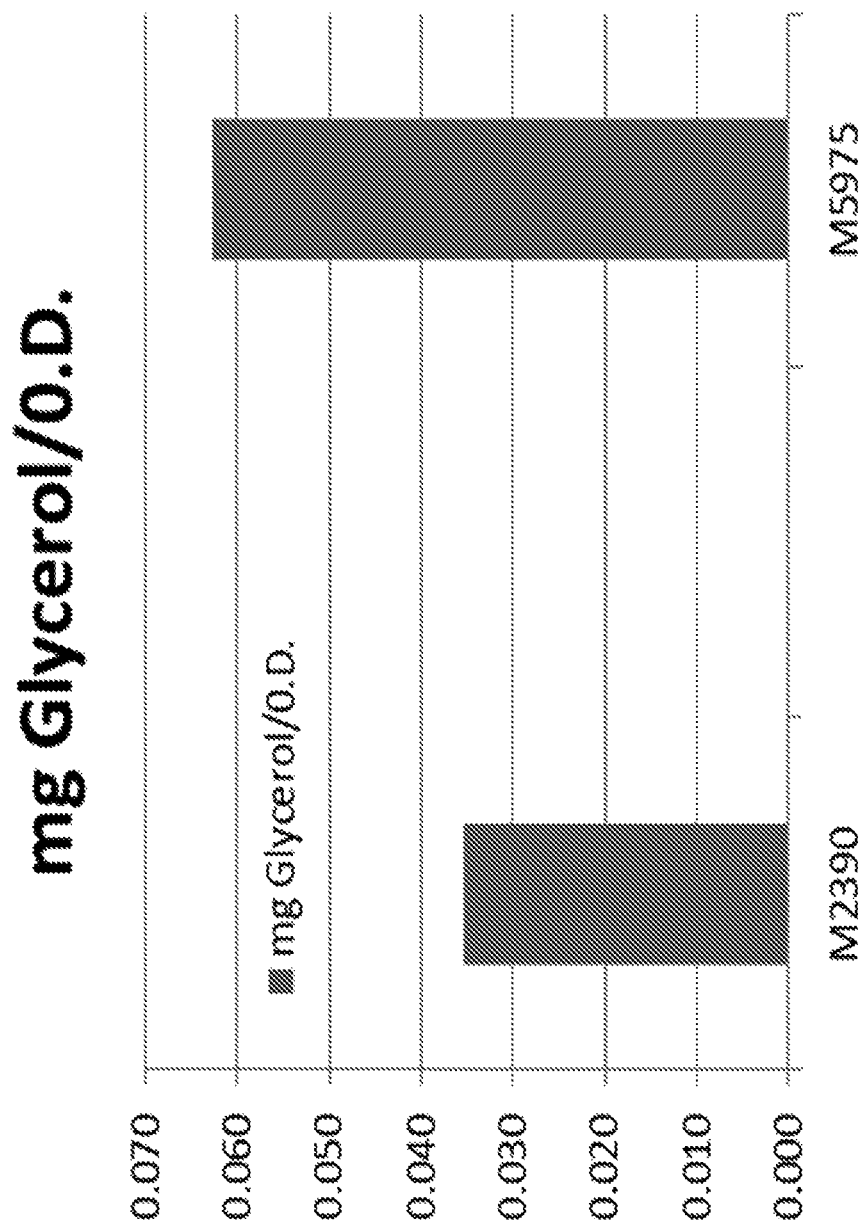

FIG. 4 depicts intracellular glycerol concentration in strains of the invention.

Figure 5:
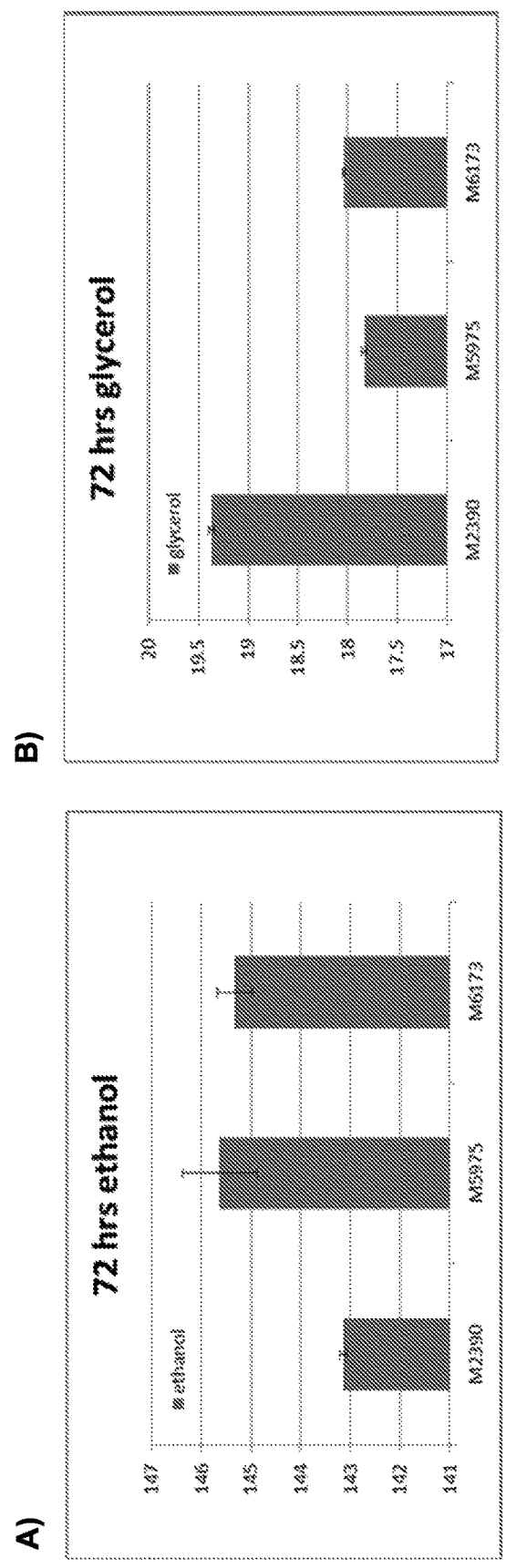

FIGS. 5A and 5B depict glycerol and ethanol titers, respectively, of strains of the invention after 72 hours of fermentation on industrial corn mash.

Figure 6:
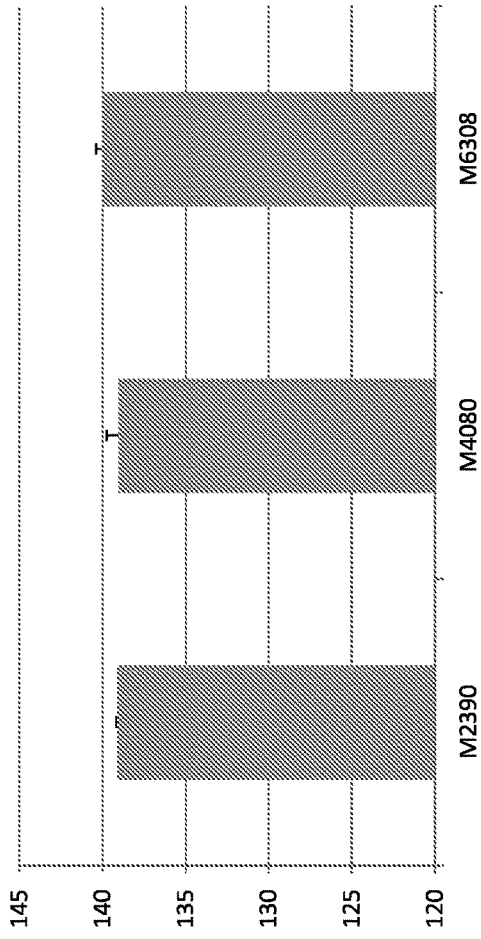
Figure 6:
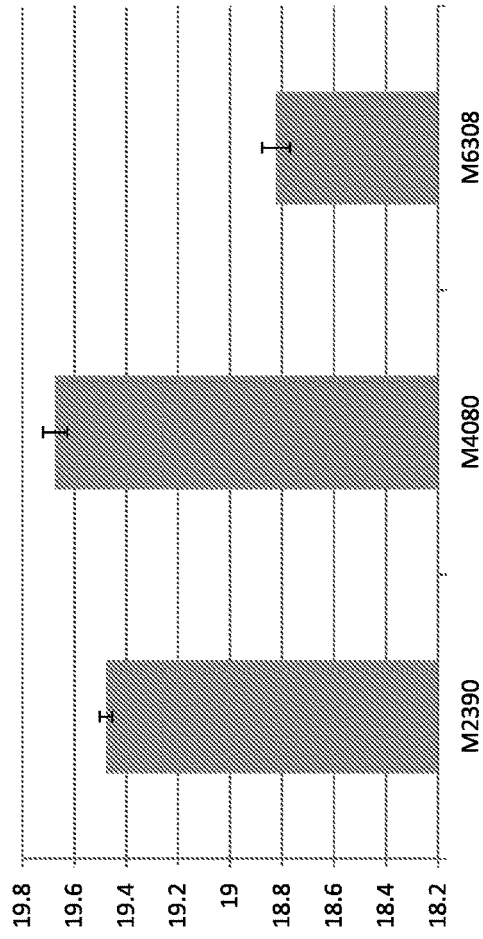

FIGS. 6A and 6B depict ethanol and glycerol titers, respectively, of the strains of the invention after 68 hours of fermentation on 33% solids corn mash.

FIGS. 7A and 7B depict ethanol and glycerol titers, respectively, of strains of the invention after 72 hours of fermentation on 33% solids corn mash.

Figure 8:
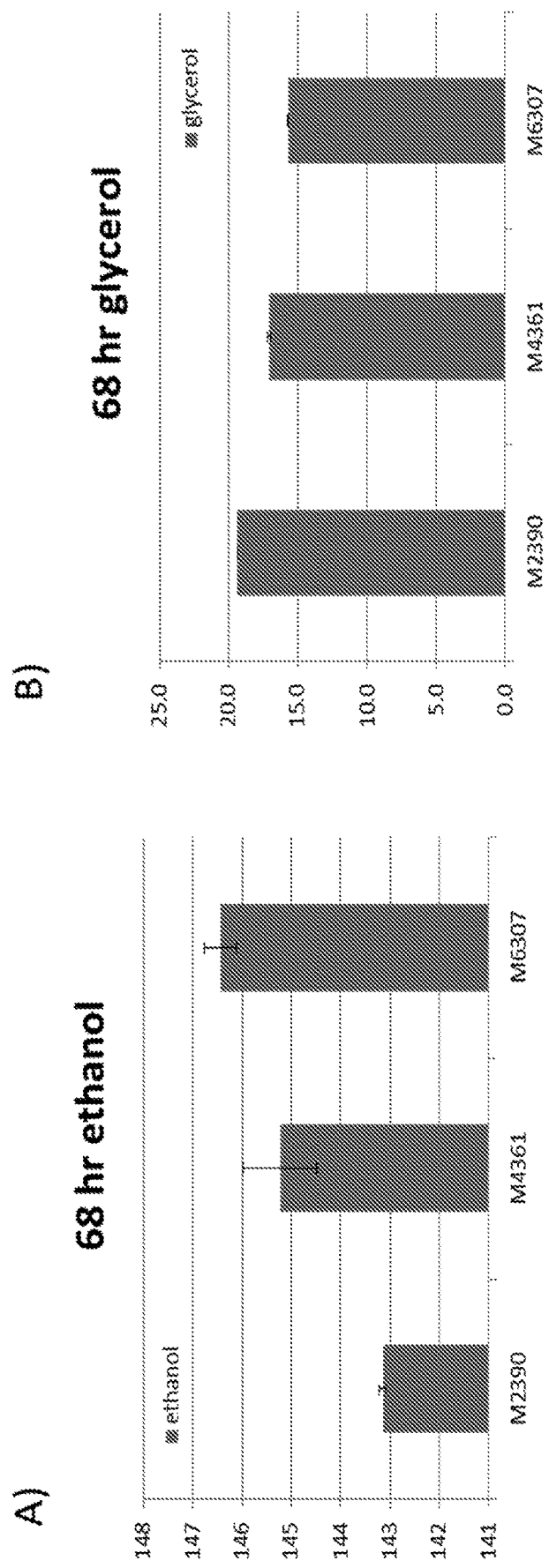

FIGS. 8A and 8B depict ethanol and glycerol titers, respectively, of strains of the invention after 68 hours of fermentation on 33% solids corn mash.

Figure 9:
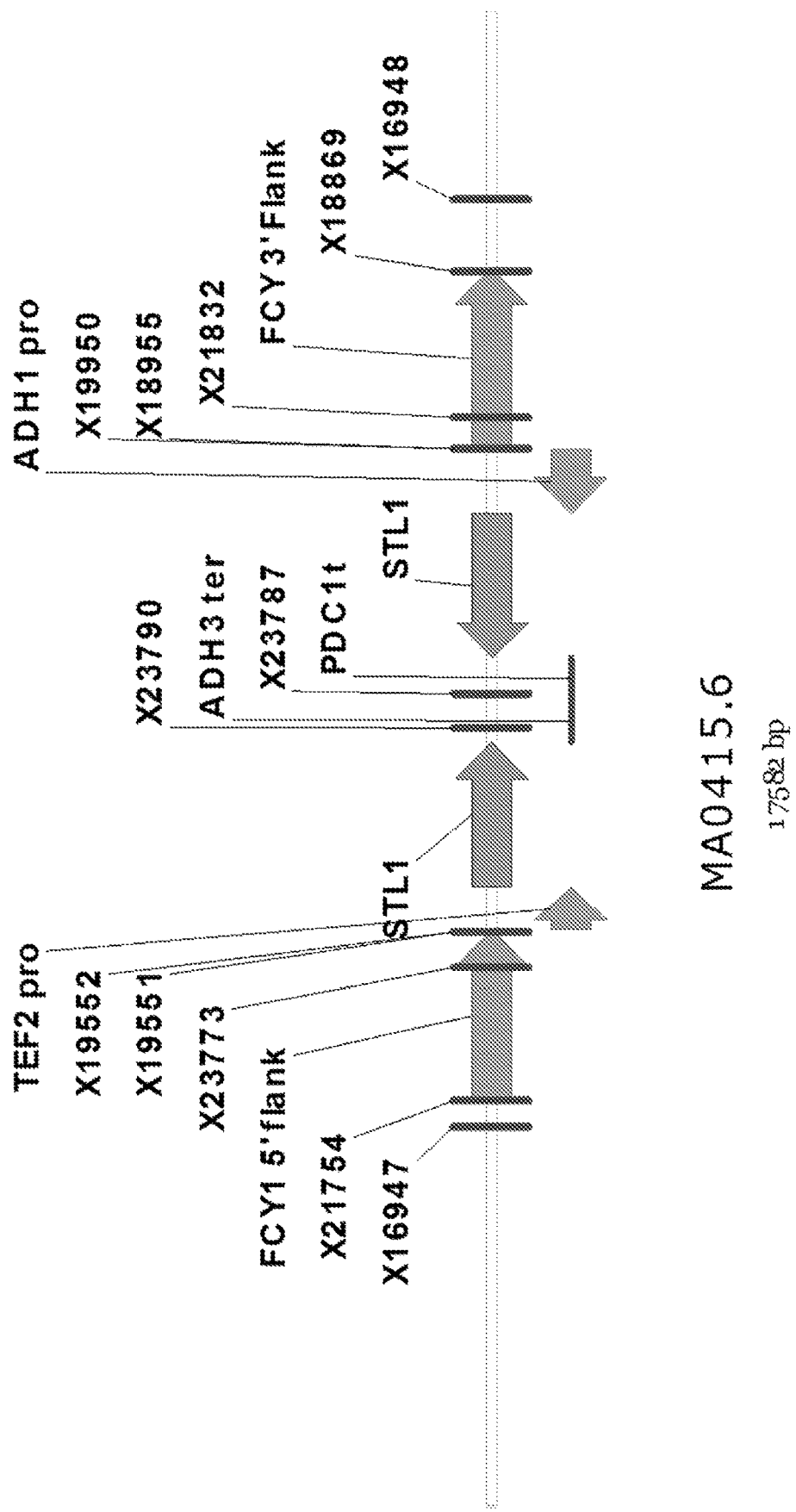

FIG. 9 shows a schematic for integration of STL1 into the FCY1 locus.

Figure 10:
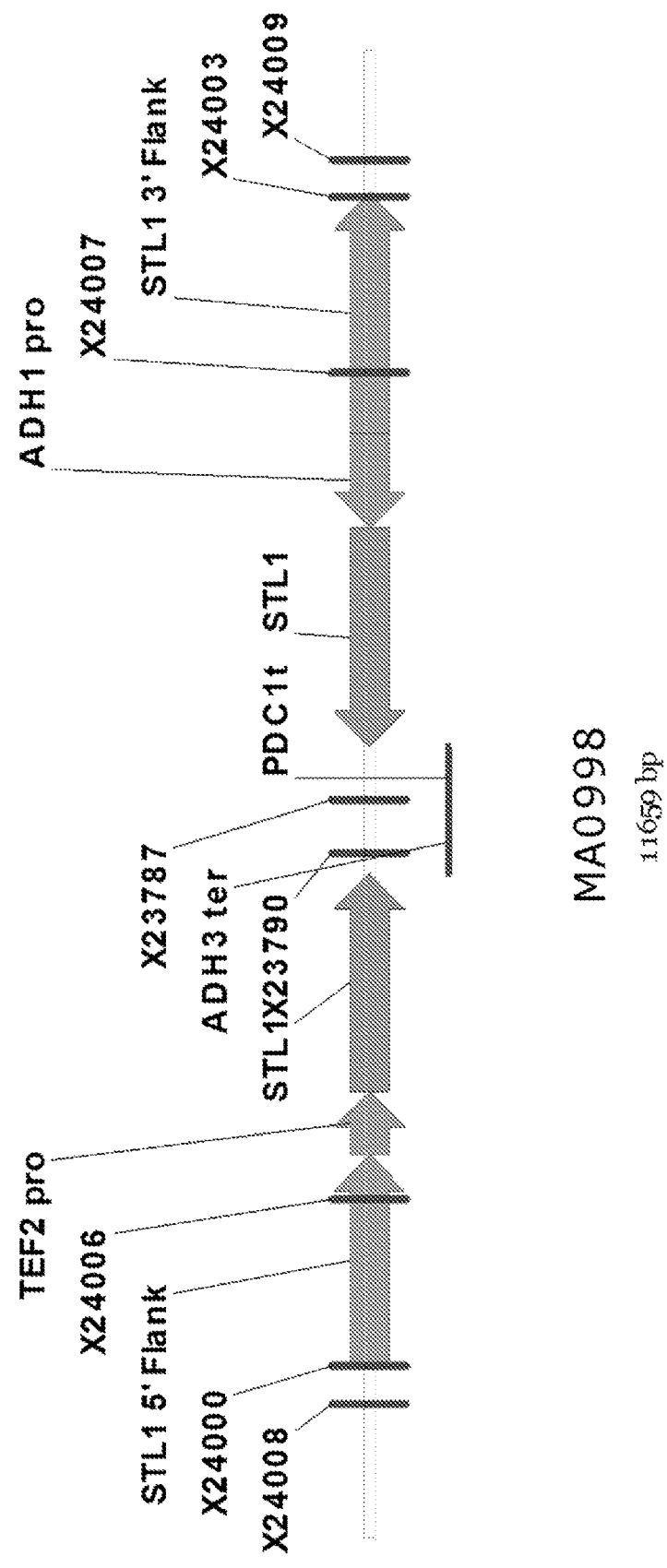

FIG. 10 shows a schematic for integration of STL1 into the STL1 locus.

Figure 11:
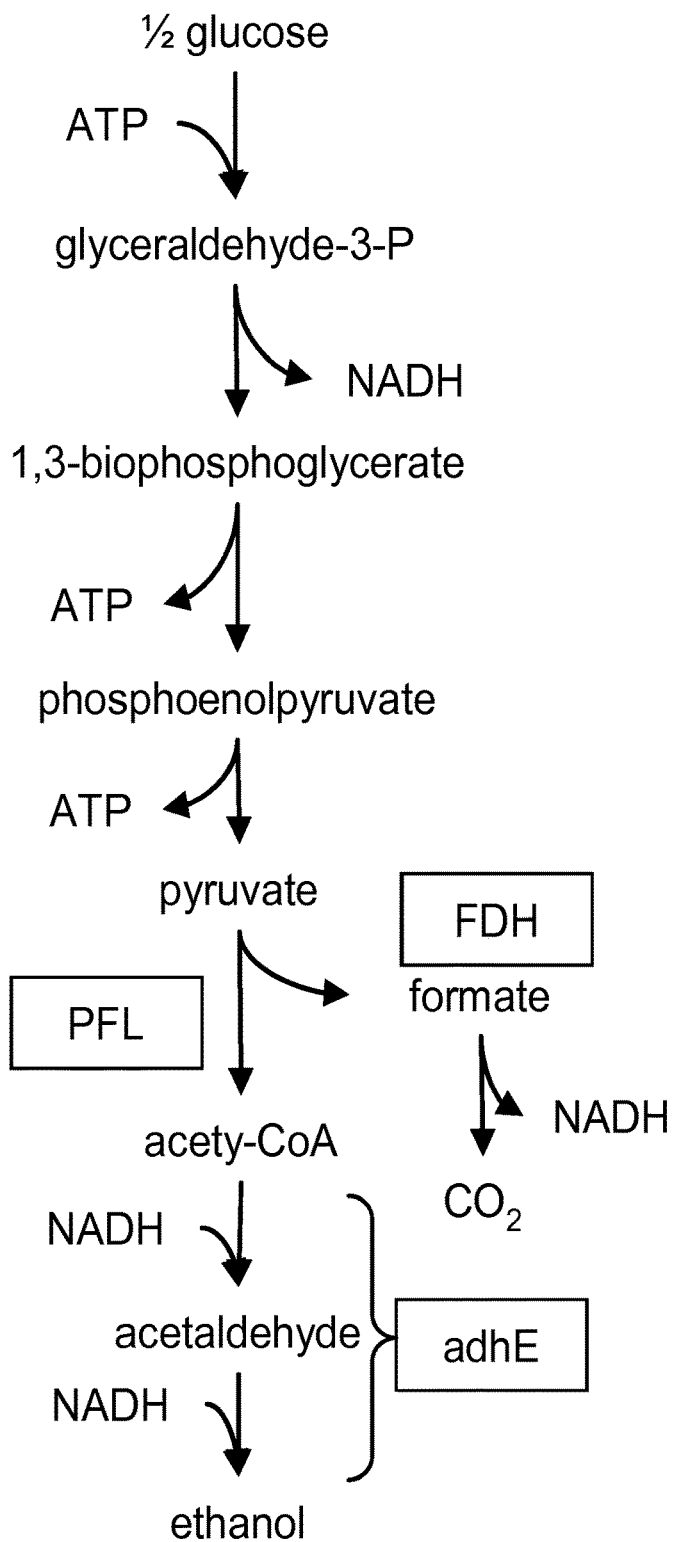

FIG. 11 shows a pathway for the recombinant production of ethanol.

Figure 12:
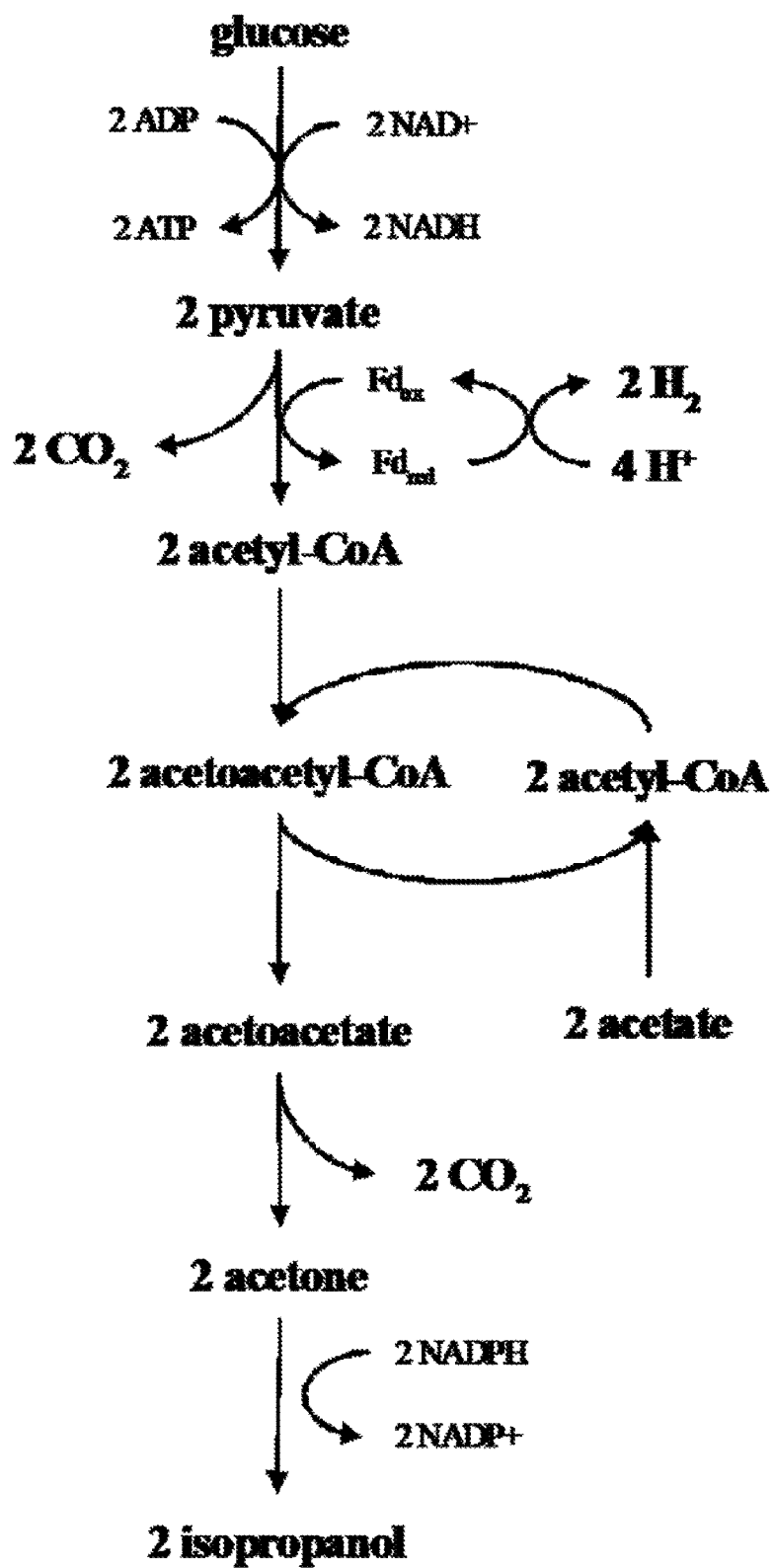

FIG. 12 shows a pathway for the recombinant production of isopropanol.

Figure 13:
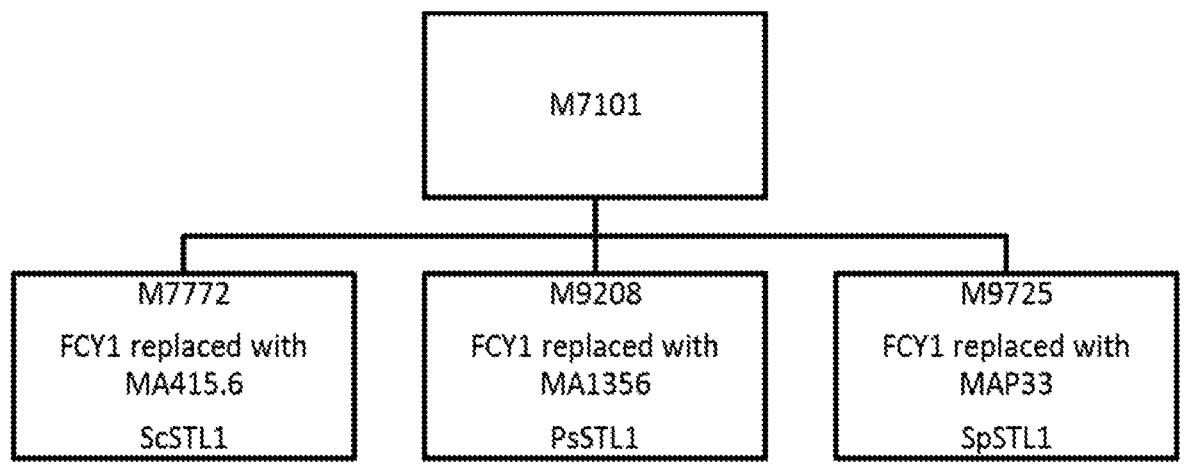

FIG. 13 shows a tree depicting the relation of the PE-2-derived STL1 overexpressing strains M7772, M9208, and M9725 to M7101.

Figure 14:
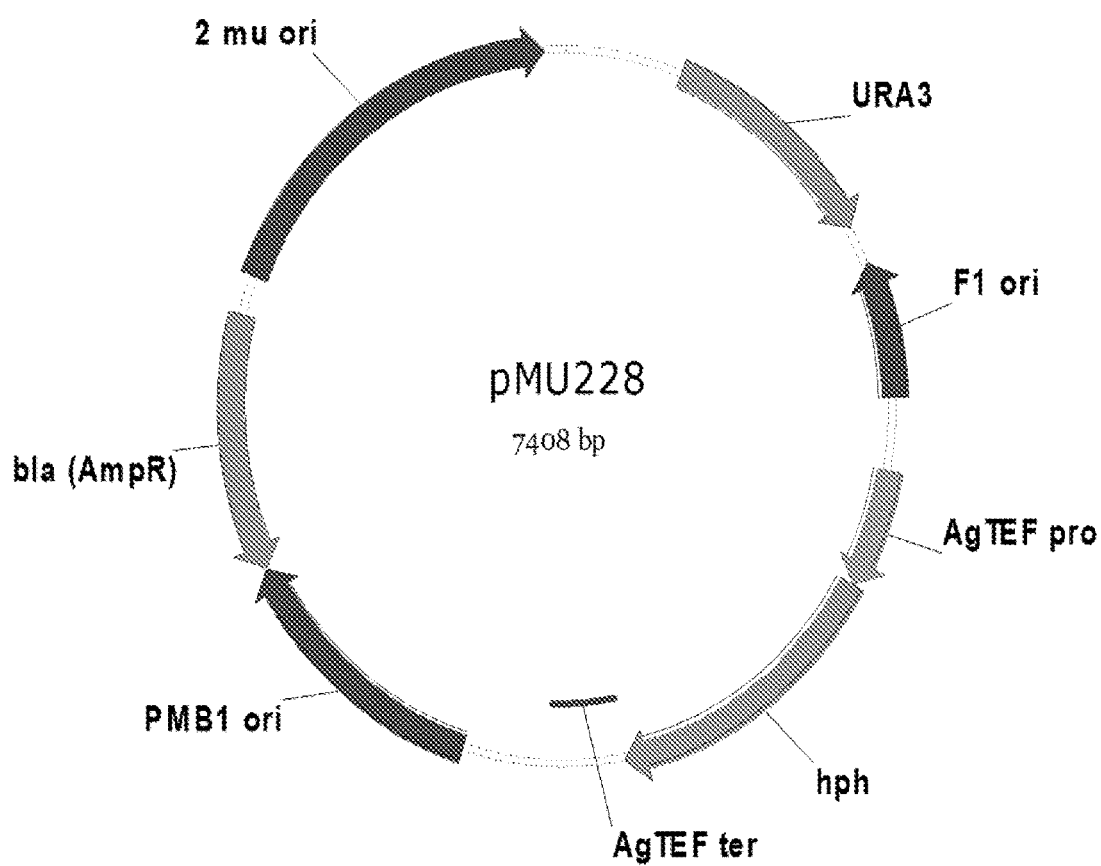

FIG. 14 shows a vector map of pMU228.

Figure 15:
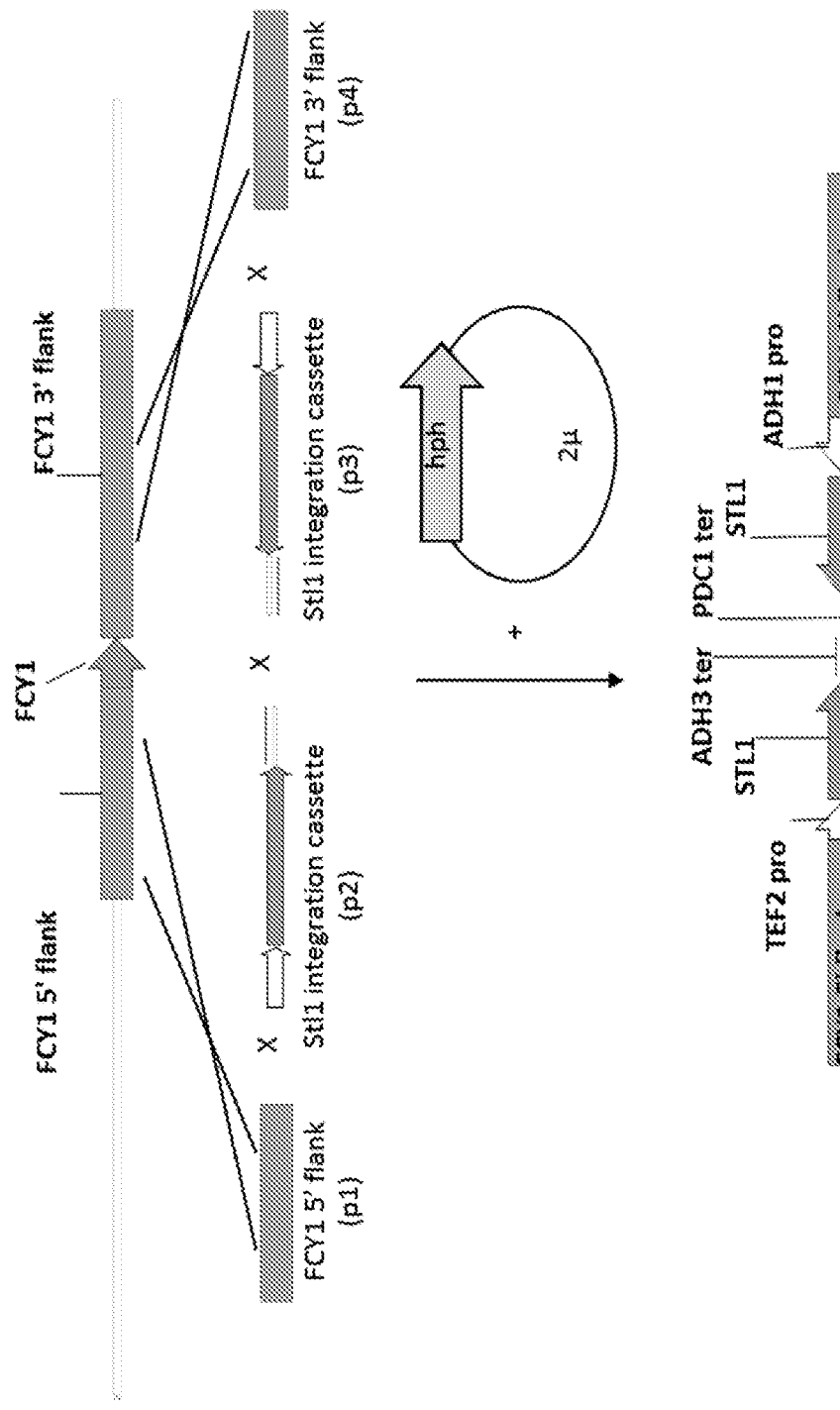

FIG. 15 shows a schematic for integration of STL1 into the FCY1 locus in creating strain M7772.

Figure 16:
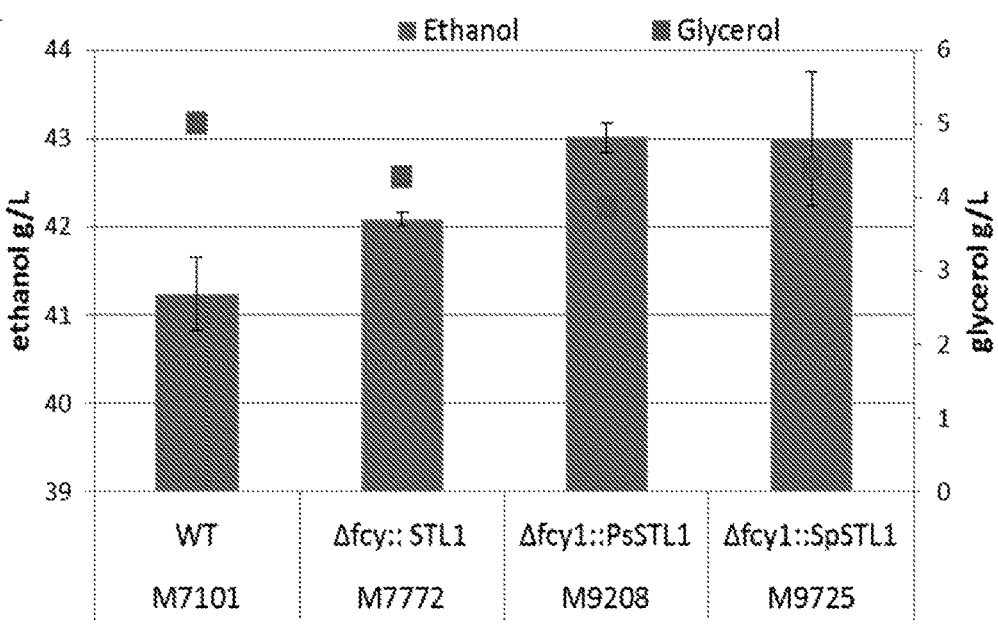
Figure 16:
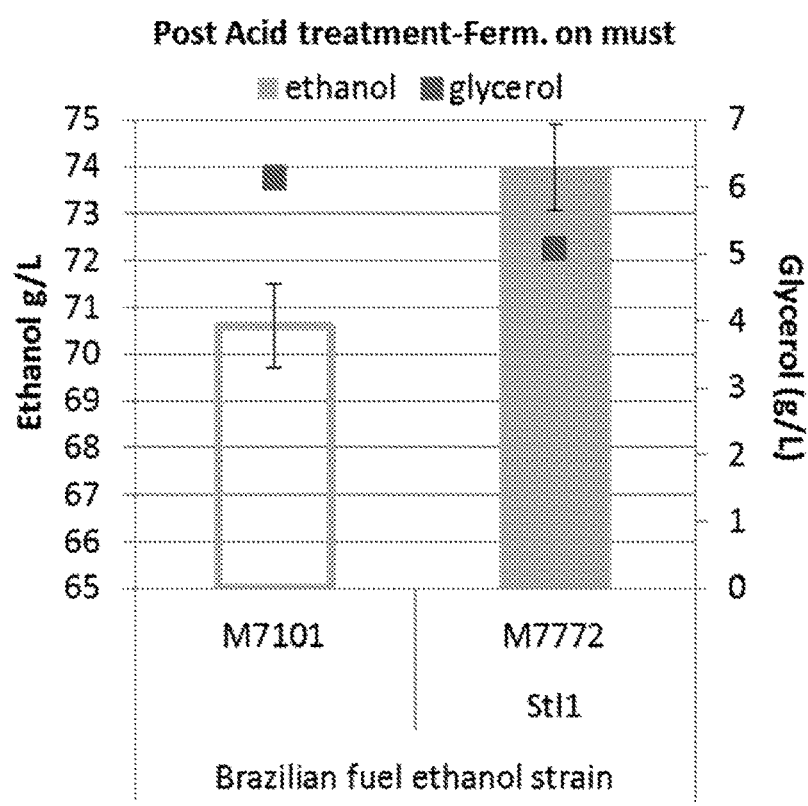

FIGS. 16A and B depict ethanol and glycerol titers of STL1 overexpressing PE-2 strains.

FIGS. 17A-D depict ethanol and glycerol titers as well as cell viability and mass accumulation of wild-type parent strain M7101 and *S. cerevisiae* STL1 overexpressing strain M7772.

DETAILED DESCRIPTION OF THE INVENTION

Definitions

Unless defined otherwise, all technical and scientific terms used herein have the same meaning as commonly understood by one of ordinary skill in the art to which this invention belongs. Also, unless otherwise required by context, singular terms shall include pluralities and plural terms shall include the singular. All publications, patents and other references mentioned herein are incorporated by reference in their entireties for all purposes.

The term "heterologous" when used in reference to a polynucleotide, a gene, a polypeptide, or an enzyme refers to a polynucleotide, gene, polypeptide, or an enzyme not normally found in the host organism. "Heterologous" also includes a native coding region, or portion thereof, that is reintroduced into the source organism in a form that is different from the corresponding native gene, e.g., not in its natural location in the organism's genome. The heterologous polynucleotide or gene may be introduced into the host organism by, e.g., gene transfer. A heterologous gene may include a native coding region that is a portion of a chimeric gene including non-native regulatory regions that is reintroduced into the native host. Foreign genes can comprise native genes inserted into a non-native organism, or chimeric genes.

The term "heterologous polynucleotide" is intended to include a polynucleotide that encodes one or more polypeptides or portions or fragments of polypeptides. A heterologous polynucleotide may be derived from any source, e.g., eukaryotes, prokaryotes, viruses, or synthetic polynucleotide fragments.

The terms "promoter" or "surrogate promoter" is intended to include a polynucleotide that can transcriptionally control a gene-of-interest that it does not transcriptionally control in nature. In certain embodiments, the transcriptional control of a surrogate promoter results in an increase in expression of the gene-of-interest. In certain embodiments, a surrogate promoter is placed 5' to the gene-of-interest. A surrogate promoter may be used to replace the natural promoter, or may be used in addition to the natural promoter. A surrogate promoter may be endogenous with regard to the host cell in which it is used, or it may be a heterologous polynucleotide sequence introduced into the host cell, e.g., exogenous with regard to the host cell in which it is used.

The terms "gene(s)" or "polynucleotide" or "polynucleotide sequence(s)" are intended to include nucleic acid molecules, e.g., polynucleotides which include an open reading frame encoding a polypeptide, and can further include non-coding regulatory sequences, and introns. In addition, the terms are intended to include one or more genes that map to a functional locus. In addition, the terms are intended to include a specific gene for a selected purpose. The gene may be endogenous to the host cell or may be recombinantly introduced into the host cell, e.g., as a plasmid maintained episomally or a plasmid (or fragment thereof) that is stably integrated into the genome. In addition to the plasmid form, a gene may, for example, be in the form of linear DNA. In certain embodiments, the gene or polynucleotide is involved in at least one step in the bioconversion of biomass to, e.g., ethanol. Accordingly, the term is intended to include any gene encoding a polypeptide, such as the enzymes acetate kinase (ACK), phosphotransacetylase (PTA), lactate dehydrogenase (LDH), pyruvate formate lyase (PFL), aldehyde dehydrogenase (ADH) and/or alcohol dehydrogenase (ADH), acetyl-CoA transferase (ACS), acetaldehyde dehydrogenase (ACDH), acetaldehyde/alcohol dehydrogenase (AADH), glycerol-3-phosphate dehydrogenase (GPD), glycerol 3-phosphatase (GPP), acetyl-CoA synthetase, thiolase, CoA transferase, acetoacetate decarboxylase, alcohol acetyltransferase enzymes in the D-xylose pathway, such as xylose isomerase and xylulokinase, enzymes in the L-arabinose pathway, such as L-arabinose isomerase and L-ribulose-5-phosphate 4-epimerase. The term gene is also intended to cover all copies of a particular gene, e.g., all of the DNA sequences in a cell encoding a particular gene product.

The term "transcriptional control" is intended to include the ability to modulate gene expression at the level of transcription. In certain embodiments, transcription, and thus gene expression, is modulated by replacing or adding a surrogate promoter near the 5' end of the coding region of a gene-of-interest, thereby resulting in altered gene expression. In certain embodiments, the transcriptional control of one or more genes is engineered to result in the optimal expression of such genes, e.g., in a desired ratio. The term also includes inducible transcriptional control as recognized in the art.

The term "expression" is intended to include the expression of a gene at least at the level of mRNA production.

The term "expression product" is intended to include the resultant product, e.g., a polypeptide, of an expressed gene.

The term "increased expression" and "overexpression" are used interchangeably and are intended to include an alteration in gene expression at least at the level of increased mRNA production and, preferably, at the level of polypeptide expression. The term "increased production" is intended to include an increase in the amount of a polypeptide expressed, in the level of the enzymatic activity of the polypeptide, or a combination thereof, as compared to the native production of, or the enzymatic activity, of the polypeptide.

The terms "activity," "activities," "enzymatic activity," and "enzymatic activities" are used interchangeably and are intended to include any functional activity normally attributed to a selected polypeptide when produced under favorable conditions. Typically, the activity of a selected polypeptide encompasses the total enzymatic activity associated with the produced polypeptide. The polypeptide produced by a host cell and having enzymatic activity may be located in the intracellular space of the cell, cell-associated, secreted into the extracellular milieu, or a combination thereof. Techniques for determining total activity as compared to secreted activity are described herein and are known in the art.

The term "xylanolytic activity" is intended to include the ability to hydrolyze glycosidic linkages in oligopentoses and polypentoses.

The term "arabinolytic activity" is intended to include the ability to hydrolyze glycosidic linkages in oligopentoses and polypentoses.

The term "cellulolytic activity" is intended to include the ability to hydrolyze glycosidic linkages in oligohexoses and polyhexoses. Cellulolytic activity may also include the ability to depolymerize or debranch cellulose and hemicellulose.

As used herein, the term "lactate dehydrogenase" or "LDH" is intended to include the enzymes capable of converting pyruvate into lactate. It is understood that LDH can also catalyze the oxidation of hydroxybutyrate. LDH includes those enzymes that correspond to Enzyme Commission Number 1.1.1.27.

As used herein the term "alcohol dehydrogenase" or "ADH" is intended to include the enzymes capable of converting acetaldehyde into an alcohol, such as ethanol. ADH also includes the enzymes capable of converting acetone to isopropanol. ADH includes those enzymes that correspond to Enzyme Commission Number 1.1.1.1.

As used herein, the term "phosphotransacetylase" or "PTA" is intended to include the enzymes capable of converting acetyl-phosphate into acetyl-CoA. PTA includes those enzymes that correspond to Enzyme Commission Number 2.3.1.8.

As used herein, the term "acetate kinase" or "ACK" is intended to include the enzymes capable of converting acetate into acetyl-phosphate. ACK includes those enzymes that correspond to Enzyme Commission Number 2.7.2.1.

As used herein, the term "pyruvate formate lyase" or "PFL" is intended to include the enzymes capable of converting pyruvate into acetyl-CoA and formate. PFL includes those enzymes that correspond to Enzyme Commission Number 2.3.1.54.

As used herein, the term "formate dehydrogenase" or "FDH" is intended to include the enzymes capable of converting formate and $NAD^+$ to NADH and $CO_2$. FDH includes those enzymes that correspond to Enzyme Commission Number 1.2.1.2.

As used herein, the term "acetaldehyde dehydrogenase" or "ACDH" is intended to include the enzymes capable of converting acetyl-CoA to acetaldehyde. ACDH includes those enzymes that correspond to Enzyme Commission Number 1.2.1.3.

As used herein, the term "acetaldehyde/alcohol dehydrogenase" is intended to include the enzymes capable of converting acetyl-CoA to ethanol. Acetaldehyde/alcohol dehydrogenase includes those enzymes that correspond to Enzyme Commission Numbers 1.2.1.10 and 1.1.1.1.

As used herein, the term "glycerol-3-phosphate dehydrogenase" or "GPD" is intended to include the enzymes capable of converting dihydroxyacetone phosphate to glycerol-3-phosphate. GPD includes those enzymes that correspond to Enzyme Commission Number 1.1.1.8, including GPD1 and GPD2. Eukaryotic GPD sequences include: *S. cerevisiae* gpd1 (SEQ ID NOs: 206 and 207) and *S. cerevisiae* gpd2 (SEQ ID NOs: 204 and 205).

As used herein, the term "glycerol 3-phosphatase" or "GPP" is intended to include the enzymes capable of converting glycerol 3-phosphate to glycerol. GPP includes those enzymes that correspond to Enzyme Commission Number 3.1.3.21, including GPP1 and GPP2.

As used herein, the term "acetyl-CoA synthetase" or "ACS" is intended to include the enzymes capable of converting acetate to acetyl-CoA. Acetyl-CoA synthetase includes those enzymes that correspond to Enzyme Commission Number 6.2.1.1. In some embodiments, ACS is from *S. cerevisiae*.

*S. cerevisiae* ACS1 nucleotide and amino acid sequences correspond to SEQ ID NO: 1 and SEQ ID NO: 2, respectively. *S. cerevisiae* ACS2 nucleotide and amino acid sequences correspond to SEQ ID NO: 3 and SEQ ID NO: 4, respectively. In some embodiments, ACS is from *Zygosaccharomyces Bailii*.

*Zygosaccharomyces Bailii* ACS nucleotide and amino acid sequences correspond to SEQ ID NO: 5 and SEQ ID NO: 6, respectively. In some embodiments, ACS is from *Salmonella enterica*. *Salmonella enterica* ACS nucleotide and amino acid sequences correspond to SEQ ID NO: 7 and SEQ ID NO: 8, respectively.

As used herein, the term "thiolase" is intended to include the enzymes capable of converting acetyl-CoA to acetoacetyl-CoA. Thiolase includes those enzymes that correspond to Enzyme Commission Number 2.3.1.9.

As used herein, the term "CoA transferase" is intended to include the enzymes capable of converting acetate and acetoacetyl-CoA to acetoacetate and acetyl-CoA. CoA transferase includes those enzymes that correspond to Enzyme Commission Number 2.8.3.8.

As used herein, the term "acetoacetate decarboxylase" is intended to include the enzymes capable of converting acetoacetate to acetone and carbon dioxide. Acetoacetate decarboxylase includes those enzymes that correspond to Enzyme Commission Number 4.1.1.4.

As used herein, the term "alcohol acetyltransferase" is intended to include the enzymes capable of converting acetyl-CoA and ethanol to ethyl acetate. Alcohol acetyltransferase includes those enzymes that correspond to Enzyme Commission Number 2.3.1.84.

The term "pyruvate decarboxylase activity" is intended to include the ability of a polypeptide to enzymatically convert pyruvate into acetaldehyde and carbon dioxide (e.g., "pyruvate decarboxylase" or "PDC"). Typically, the activity of a selected polypeptide encompasses the total enzymatic activity associated with the produced polypeptide, comprising, e.g., the superior substrate affinity of the enzyme, thermostability, stability at different pHs, or a combination of these attributes. PDC includes those enzymes that correspond to Enzyme Commission Number 4.1.1.1.

As used herein, the term "sugar transporter-like protein," "STL1" or "Stl1p" is intended to include glycerol proton symporter proteins capable of transporting glycerol across a plasma membrane. Included within the scope of this term are the *S. cerevisiae* glycerol active transporter, as well as those from other yeast such as *C. albicans, Saccharomyces paradoxus*, and *Pichia sorbitophila*.

As used herein, the term "arabinose isomerase" is intended to include the enzymes capable of converting L-arabinose to L-ribulose. Arabinose isomerase includes those enzymes that correspond to Enzyme Commission Number 5.3.1.4. In some embodiments, arabinose isomerase is from *B. thetaiotaomicron*. *B. thetaiotaomicron* arabinose isomerase nucleotide and amino acid sequences correspond to SEQ ID NO: 133 and SEQ ID NO: 134, respectively.

As used herein, the term "ribulokinase" is intended to include the enzymes capable of converting L- or D-ribulose to L- or D-ribulose 5-phosphate. Ribulokinase includes those enzymes that correspond to Enzyme Commission Number 2.7.1.16. In some embodiments, ribulokinase is araB from *B. thetaiotaomicron*. *B. thetaiotaomicron* araB nucleotide and amino acid sequences correspond to SEQ ID NO: 135 and SEQ ID NO: 136, respectively.

As used herein, the term "ribulose-5-phosphate epimerase" or "D-ribulose-5-phosphate 3-epimerase" is intended to include the enzymes capable of converting D-ribulose 5-phosphate to D-xylulose 5-phosphate. Ribulose-5-phosphate epimerase or D-ribulose-5-phosphate 3-epimerase include those enzymes that correspond to Enzyme Commission Number 5.1.3.1.

In some embodiments, ribulose-5-phosphate epimerase is from *B. thetaiotaomicron*. *B. thetaiotaomicron* ribulose-5-phosphate epimerase nucleotide and amino acid sequences correspond to SEQ ID NO: 137 and SEQ ID NO: 138, respectively.

As used herein, the term "xylose isomerase" or "XI" is meant to refer to an enzyme that catalyzes the chemical reaction: D-xylose⇌D-xylulose. This enzyme belongs to the family of isomerases, specifically those intramolecular oxidoreductases interconverting aldoses and ketoses. The systematic name of this enzyme class is D-xylose aldose-ketose-isomerase. Other names in common use include D-xylose isomerase, D-xylose ketoisomerase, and D-xylose ketol-isomerase. This enzyme participates in pentose and glucuronate interconversions and fructose and mannose metabolism. The enzyme is used industrially to convert glucose to fructose in the manufacture of high-fructose corn syrup. It is sometimes referred to as "glucose isomerase". XI includes those enzymes that correspond to Enzyme Commission Number 5.3.1.5.

Figure 7:
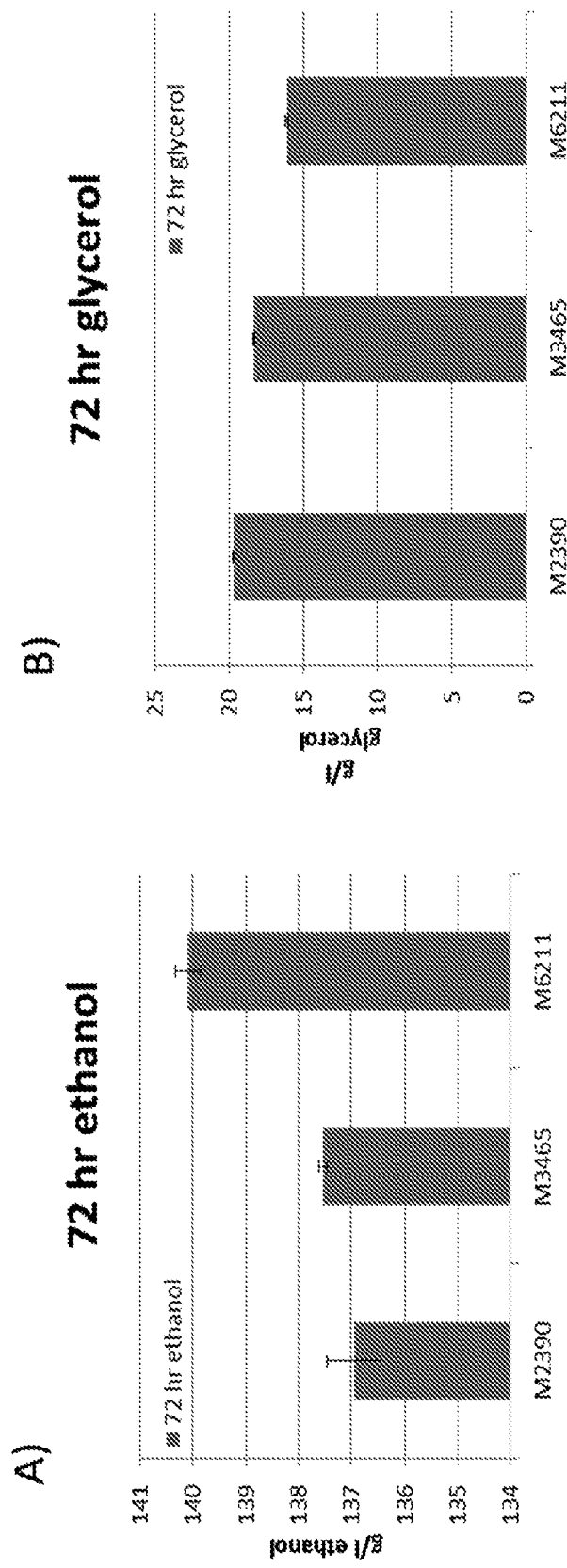

As used herein, the term "phosphoketolase", "single-specificity phosphoketolase" or "dual-specificity phosphoketolase" is intended to include the enzymes that catalyze the conversion of D-xylulose 5-phosphate to D-glyceraldehyde 3-phosphate. Dual specificity phosphoketolase additionally includes the enzymes that catalyze the conversion of D-fructose 6-phosphate to D-erythrose 4-phosphate. Phosphoketolase, single-specificity phosphoketolase and dual-specificity phosphoketolase are referred to collectively as "PHKs" or "phosphoketolase" (FIG. 7). PHKs include those enzymes that correspond to Enzyme Commission Number (EC) 4.1.2.9 and 4.1.2.22. In some embodiments, PHK is from *A. niger* (SEQ ID NOs: 143 and 144), *N. crassa* (SEQ ID NOs: 145 and 146), *L. casei* PHK (SEQ ID NOs: 147 and 148), *L. plantarum* PHK1 (SEQ ID NOs: 149 and 150), *L. plantarum* PHK2 (SEQ ID NOs: 151 and 152), *B. adolescentis* (SEQ ID NOs: 153 and 154), *B. bifidum* (SEQ ID NOs: 155 and 156), *B. gallicum* (SEQ ID NOs: 157 and 158), *B. animalis* (SEQ ID NOs: 159 and 160), *L. pentosum* (SEQ ID NOs: 161 and 162), *L. acidophilus* (SEQ ID NOs: 163 and 164), *P. chrysogenum* (SEQ ID NOs: 165 and 166), *A. nidulans* (SEQ ID NOs: 167 and 168), *A. clavatus* (SEQ ID NOs: 169 and 170), *L. mesenteroides* (SEQ ID NOs: 171 and 172), or *O. oenii* (SEQ ID NOs: 173 and 174).

As used herein, the term "phosphotransacetylase" or "PTA" is intended to include the enzymes capable of converting acetyl-phosphate into acetyl-CoA. PTA includes those enzymes that correspond to Enzyme Commission Number 2.3.1.8.

As used herein, the term "acetate kinase" or "ACK" is intended to include the enzymes capable of converting acetate into acetyl-phosphate or acetyl-P. ACK includes those enzymes that correspond to Enzyme Commission Number 2.7.2.1.

The term "ethanologenic" is intended to include the ability of a microorganism to produce ethanol from a carbohydrate as a fermentation product. The term is intended to include, but is not limited to, naturally occurring ethanologenic organisms, ethanologenic organisms with naturally occurring or induced mutations, and ethanologenic organisms which have been genetically modified.

The terms "fermenting" and "fermentation" are intended to include the enzymatic process (e.g., cellular or acellular, e.g., a lysate or purified polypeptide mixture) by which ethanol is produced from a carbohydrate, in particular, as a product of fermentation.

The term "secreted" is intended to include the movement of polypeptides to the periplasmic space or extracellular milieu. The term "increased secretion" is intended to include situations in which a given polypeptide is secreted at an increased level (i.e., in excess of the naturally-occurring amount of secretion). In certain embodiments, the term "increased secretion" refers to an increase in secretion of a given polypeptide that is at least about 10% or at least about 100%, 200%, 300%, 400%, 500%, 600%, 700%, 800%, 900%, 1000%, or more, as compared to the naturally-occurring level of secretion.

The term "secretory polypeptide" is intended to include any polypeptide(s), alone or in combination with other polypeptides, that facilitate the transport of another polypeptide from the intracellular space of a cell to the extracellular milieu. In certain embodiments, the secretory polypeptide(s) encompass all the necessary secretory polypeptides sufficient to impart secretory activity to a Gram-negative or Gram-positive host cell or to a yeast host cell. Typically, secretory proteins are encoded in a single region or locus that may be isolated from one host cell and transferred to another host cell using genetic engineering. In certain embodiments, the secretory polypeptide(s) are derived from any bacterial cell having secretory activity or any yeast cell having secretory activity. In certain embodiments, the secretory polypeptide(s) are derived from a host cell having Type II secretory activity. In certain embodiments, the host cell is a thermophilic bacterial cell. In certain embodiments, the host cell is a yeast cell.

The term "derived from" is intended to include the isolation (in whole or in part) of a polynucleotide segment from an indicated source or the purification of a polypeptide from an indicated source. The term is intended to include, for example, direct cloning, PCR amplification, or artificial synthesis from or based on a sequence associated with the indicated polynucleotide source.

The term "recombinant microorganism" or "recombinant host cell" is intended to include progeny or derivatives of the recombinant microorganisms of the invention. Because certain modifications may occur in succeeding generations due to either mutation or environmental influences, such progeny or derivatives may not, in fact, be identical to the parent cell, but are still included within the scope of the term as used herein.

By "thermophilic" is meant an organism that thrives at a temperature of about 45° C. or higher.

By "mesophilic" is meant an organism that thrives at a temperature of about 20-45° C.

The term "organic acid" is art-recognized. "Organic acid," as used herein, also includes certain organic solvents such as ethanol. The term "lactic acid" refers to the organic acid 2-hydroxypropionic acid in either the free acid or salt form. The salt form of lactic acid is referred to as "lactate" regardless of the neutralizing agent, i.e., calcium carbonate or ammonium hydroxide. The term "acetic acid" refers to the organic acid methanecarboxylic acid, also known as ethanoic acid, in either free acid or salt form. The salt form of acetic acid is referred to as "acetate."

Certain embodiments of the present invention provide for the "insertion," (e.g., the addition, integration, incorporation, or introduction) of certain genes or particular polynucleotide sequences within thermophilic or mesophilic microorganisms, which insertion of genes or particular polynucleotide sequences may be understood to encompass "genetic modification(s)" or "transformation(s)" such that the resulting strains of said thermophilic or mesophilic microorganisms may be understood to be "genetically modified" or "transformed." In certain embodiments, strains may be of bacterial, fungal, or yeast origin.

Certain embodiments of the present invention provide for the "inactivation" or "deletion" of certain genes or particular polynucleotide sequences within thermophilic or mesophilic microorganisms, which "inactivation" or "deletion" of genes or particular polynucleotide sequences may be understood to encompass "genetic modification(s)" or "transformation(s)" such that the resulting strains of said thermophilic or mesophilic microorganisms may be understood to be "genetically modified" or "transformed." In certain embodiments, strains may be of bacterial, fungal, or yeast origin.

The term "consolidated bioprocessing" or "CBP" refers to biomass processing schemes involving enzymatic or microbial hydrolysis that commonly involve four biologically mediated transformations: (1) the production of saccharolytic enzymes (amylases, cellulases, and hemicellulases); (2) the hydrolysis of carbohydrate components present in pre-treated biomass to sugars; (3) the fermentation of hexose sugars (e.g., glucose, mannose, and galactose); and (4) the fermentation of pentose sugars (e.g., xylose and arabinose). These four transformations occur in a single step in a process configuration called CBP, which is distinguished from other less highly integrated configurations in that it does not involve a dedicated process step for cellulase and/or hemicellulase production.

The term "CBP organism" is intended to include microorganisms of the invention, e.g., microorganisms that have properties suitable for CBP.

In one aspect of the invention, the genes or particular polynucleotide sequences are inserted to activate the activity for which they encode, such as the expression of an enzyme. In certain embodiments, genes encoding enzymes in the metabolic production of ethanol, e.g., enzymes that metabolize pentose and/or hexose sugars, may be added to a mesophilic or thermophilic organism. In certain embodiments of the invention, the enzyme may confer the ability to metabolize a pentose sugar and be involved, for example, in the D-xylose pathway and/or L-arabinose pathway.

In one aspect of the invention, the genes or particular polynucleotide sequences are partially, substantially, or completely deleted, silenced, inactivated, or down-regulated in order to inactivate the activity for which they encode, such as the expression of an enzyme. Deletions provide maximum stability because there is no opportunity for a reverse mutation to restore function. Alternatively, genes can be partially, substantially, or completely deleted, silenced, inactivated, or down-regulated by insertion of nucleic acid sequences that disrupt the function and/or expression of the gene (e.g., P1 transduction or other methods known in the art). The terms "eliminate," "elimination," and "knockout" are used interchangeably with the terms "deletion," "partial deletion," "substantial deletion," or "complete deletion." In certain embodiments, strains of thermophilic or mesophilic microorganisms of interest may be engineered by site directed homologous recombination to knockout the production of organic acids. In still other embodiments, RNAi or antisense DNA (asDNA) may be used to partially, substantially, or completely silence, inactivate, or down-regulate a particular gene of interest.

In certain embodiments, the genes targeted for deletion or inactivation as described herein may be endogenous to the native strain of the microorganism, and may thus be understood to be referred to as "native gene(s)" or "endogenous gene(s)." An organism is in "a native state" if it has not been genetically engineered or otherwise manipulated by the hand of man in a manner that intentionally alters the genetic and/or phenotypic constitution of the organism. For example, wild-type organisms may be considered to be in a native state. In other embodiments, the gene(s) targeted for deletion or inactivation may be non-native to the organism.

Similarly, the enzymes of the invention as described herein can be endogenous to the native strain of the microorganism, and can thus be understood to be referred to as "native" or "endogenous."

The term "upregulated" means increased in activity, e.g., increase in enzymatic activity of the enzyme as compared to activity in a native host organism.

The term "downregulated" means decreased in activity, e.g., decrease in enzymatic activity of the enzyme as compared to activity in a native host organism.

The term "activated" means expressed or metabolically functional.

The term "adapted for growing" means selection of an organism for growth under conditions in which the organism does not otherwise grow or in which the organism grows slowly or minimally. Thus, an organism that is said to be adapted for growing under the selected condition, grows better than an organism that has not been adapted for growing under the selected conditions. Growth can be measured by any methods known in the art, including, but not limited to, measurement of optical density or specific growth rate.

The term "carbohydrate source" is intended to include any source of carbohydrate including, but not limited to, biomass or carbohydrates, such as a sugar or a sugar alcohol. "Carbohydrates" include, but are not limited to, monosaccharides (e.g., glucose, fructose, galactose, xylose, arabinose, or ribose), sugar derivatives (e.g., sorbitol, glycerol, galacturonic acid, rhamnose, xylitol), disaccharides (e.g., sucrose, cellobiose, maltose, or lactose), oligosaccharides (e.g., xylooligomers, cellodextrins, or maltodextrins), and polysaccharides (e.g., xylan, cellulose, starch, mannan, alginate, or pectin).

As used herein, an "amylolytic enzyme" can be any enzyme involved in amylase digestion, metabolism and/or hydrolysis. The term "amylase" refers to an enzyme that breaks starch down into sugar. Amylase is present in human saliva, where it begins the chemical process of digestion. Foods that contain much starch but little sugar, such as rice and potato, taste slightly sweet as they are chewed because amylase turns some of their starch into sugar in the mouth. The pancreas also makes amylase ($\alpha$-amylase) to hydrolyse dietary starch into disaccharides and trisaccharides which are converted by other enzymes to glucose to supply the body with energy. Plants and some bacteria also produce amylase. All amylases are glycoside hydrolases and act on $\alpha$-1,4-glycosidic bonds. Some amylases, such as $\gamma$-amylase (glucoamylase), also act on $\alpha$-1,6-glycosidic bonds. Amylase enzymes include $\alpha$-amylase (EC 3.2.1.1), $\beta$-amylase (EC 3.2.1.2), and $\gamma$-amylase (EC 3.2.1.3). The $\alpha$-amylases are calcium metalloenzymes, unable to function in the absence of calcium. By acting at random locations along the starch chain, α-amylase breaks down long-chain carbohydrates, ultimately yielding maltotriose and maltose from amylose, or maltose, glucose and "limit dextrin" from amylopectin. Because it can act anywhere on the substrate, α-amylase tends to be faster-acting than β-amylase. In animals, it is a major digestive enzyme and its optimum pH is about 6.7-7.0. Another form of amylase, β-amylase is also synthesized by bacteria, fungi, and plants. Working from the non-reducing end, β-amylase catalyzes the hydrolysis of the second α-1,4 glycosidic bond, cleaving off two glucose units (maltose) at a time. Many microbes produce amylase to degrade extracellular starches. In addition to cleaving the last α(1-4)glycosidic linkages at the nonreducing end of amylose and amylopectin, yielding glucose, γ-amylase will cleave α(1-6) glycosidic linkages. Another amylolytic enzyme is alpha-glucosidase that acts on maltose and other short malto-oligosaccharides produced by alpha-, beta-, and gamma-amylases, converting them to glucose. Another amylolytic enzyme is pullulanase. Pullulanase is a specific kind of glucanase, an amylolytic exoenzyme, that degrades pullulan. Pullulan is regarded as a chain of maltotriose units linked by alpha-1,6-glycosidic bonds. Pullulanase (EC 3.2.1.41) is also known as pullulan-6-glucanohydrolase (Debranching enzyme). Another amylolytic enzyme, isopullulanase, hydrolyses pullulan to isopanose (6-alpha-maltosylglucose). Isopullulanase (EC 3.2.1.57) is also known as pullulan 4-glucanohydrolase. An "amylase" can be any enzyme involved in amylase digestion, metabolism and/or hydrolysis, including α-amylase, β-amylase, glucoamylase, pullulanase, isopullulanase, and alpha-glucosidase.

As used herein, a "saccharolytic enzyme" can be any enzyme involved in carbohydrate digestion, metabolism and/or hydrolysis, including amylases, cellulases, hemicellulases, cellulolytic and amylolytic accessory enzymes, inulinases, levanases, and pentose sugar utilizing enzymes. In certain embodiments, the saccharolytic enzyme is a hemicellulase. Various hemicellulases can be used in the present invention, including but not limited to those described in co-owned International Application No. PCT/US2014/026499 filed Mar. 13, 2014, which is incorporated by reference in its entirety herein. Additional non-limiting hemicellulase examples include hemicellulases obtained from a microorganism selected from the group consisting of Neosartorya fischeri, Pyrenophora tritici-repentis, Aspergillus niger, Aspergillus fumigatus, Aspergillus oryzae, Trichoderma reesei, and Aspergillus Aculeatus. Table 1 lists exemplary hemicellulases that can be engineered, as indicated, in the recombinant microorganisms of the invention. The plasmids and strains presented in Table 1 are disclosed in co-owned International Application Publication Nos. WO 2014/035458, which is herein incorporated by reference in its entirety.

TABLE 1

| Fungal Cellulase (FC)# | Enzyme type* | Modification | Activity | Organism | GenBank Accession # | Strain # | Plasmid # | SEQ ID NO: (DNA/Protein) |
|---|---|---|---|---|---|---|---|---|
| 7 | CE1 | Overexpression | acetylxylanesterase | Neosartorya fischeri | XP_001262186 | M1514 | pMU1934 | 175/176 |
| 36 | GH43 | Overexpression | beta-xylosidase, HIS tagged | Pyrenophora tritici-repentis | XP_001940956 | M1834 | pMU2173 | 177/178 |
| 138 | GH10 | Overexpression | Endo-xylanase | Aspergillus niger | CAA03655.1 | M3441 | pMU2816 | 179/180 |
| 136 | CE16 | Overexpression | Acetyl esterase | Aspergillus fumigatus | XP_749200 | M3325 | pMU3138 | 181/182 |
| 106 | GH115 | Overexpression | α-glucuronidase | Aspergillus oryzae | BAE56806 | M3511 | pMU3220 | 183/184 |
| 110 | GH115 | Overexpression | α-glucuronidase | Aspergillus fumigatus | XP_749042 | M3449 | pMU3161 | 185/186 |
| 140 | GH3 | Overexpression | β-glucosidase | Saccharomycopsis fibuligera | P22506 | | pMU2301 | 187/188 |
| 139 | GH31 | Overexpression | α-galactosidase | Trichoderma reesei | Z69253 | M2665 | pMU2981 | 189/190 |
| 142 | GH5/GH2 | Overexpression | β-mannase | Trichoderma reesei | L25310 | M2351 | pMU2659 | 191/192 |
| 124 | GH5/GH2 | Overexpression | endo-β-mannanase/mannosidase | Neosartorya fischeri | XP_001262744 | M3318 | pMU3131 | 193/194 |
| 72 | GH7B | Overexpression | Endoglucanase (EG1) | Aspergillus fumigatus | XP_747897 | M1311 | pMU1626 | 195/196 |
| 148 | GH3 | Overexpression | beta-glucosidase, HIS tagged | Aspergillus Aculeatus | P48825 | | pMU3559 | 197/198 |

*"Enzyme type" is descriptive in the field for the type of enzyme, and each enzyme is further defined in the "activity" column.

The terms "industrial corn mash," "solids corn mash," and "corn mash" are used interchangeably and are intended to include liquefied corn obtained from a commercial facility.

Biomass

Biomass can include any type of biomass known in the art or described herein. For example, biomass can include, but is not limited to, starch, sugar, and lignocellulosic materials. Starch materials can include, but are not limited to, mashes such as corn, wheat, rye, barley, rice, or milo. Sugar materials can include, but are not limited to, sugar beets, artichoke tubers, sweet sorghum, or cane. The terms "lignocellulosic material," "lignocellulosic substrate," and "cellulosic biomass" mean any type of biomass comprising cellulose, hemicellulose, lignin, or combinations thereof, such as but not limited to woody biomass, forage grasses, herbaceous energy crops, non-woody-plant biomass, agricultural wastes and/or agricultural residues, forestry residues and/or forestry wastes, paper-production sludge and/or waste paper sludge, waste-water-treatment sludge, municipal solid waste, corn fiber from wet and dry mill corn ethanol plants, and sugar-processing residues. The terms "hemicellulosics," "hemicellulosic portions," and "hemicellulosic fractions" mean the non-lignin, non-cellulose elements of lignocellulosic material, such as but not limited to hemicellulose (i.e., comprising xyloglucan, xylan, glucuronoxylan, arabinoxylan, mannan, glucomannan, and galactoglucomannan, inter alia), pectins (e.g., homogalacturonans, rhamnogalacturonan I and II, and xylogalacturonan), and proteoglycans (e.g., arabinogalactan-protein, extensin, and proline-rich proteins).

In a non-limiting example, the lignocellulosic material can include, but is not limited to, woody biomass, such as recycled wood pulp fiber, sawdust, hardwood, softwood, and combinations thereof; grasses, such as switch grass, cord grass, rye grass, reed canary grass, *miscanthus*, or a combination thereof; sugar-processing residues, such as but not limited to sugar cane bagasse; agricultural wastes, such as but not limited to rice straw, rice hulls, barley straw, corn cobs, cereal straw, wheat straw, canola straw, oat straw, oat hulls, and corn fiber; stover, such as but not limited to soybean stover, corn stover; succulents, such as but not limited to, Agave; and forestry wastes, such as but not limited to, recycled wood pulp fiber, sawdust, hardwood (e.g., poplar, oak, maple, birch, willow), softwood, or any combination thereof. Lignocellulosic material may comprise one species of fiber; alternatively, lignocellulosic material may comprise a mixture of fibers that originate from different lignocellulosic materials. Other lignocellulosic materials are agricultural wastes, such as cereal straws, including wheat straw, barley straw, canola straw and oat straw; corn fiber; stovers, such as corn stover and soybean stover; grasses, such as switch grass, reed canary grass, cord grass, and *miscanthus*; or combinations thereof.

Paper sludge is also a viable feedstock for lactate or acetate production. Paper sludge is solid residue arising from pulping and paper-making, and is typically removed from process wastewater in a primary clarifier. At a disposal cost of $30/wet ton, the cost of sludge disposal equates to $5/ton of paper that is produced for sale. The cost of disposing of wet sludge is a significant incentive to convert the material for other uses, such as conversion to ethanol. Processes provided by the present invention are widely applicable. Moreover, the saccharification and/or fermentation products may be used to produce ethanol or higher value added chemicals, such as organic acids, aromatics, esters, acetone and polymer intermediates.

Glycerol Reduction

Anaerobic growth conditions require the production of endogenous electron acceptors, such as the coenzyme nicotinamide adenine dinucleotide ($NAD^+$). In cellular redox reactions, the $NAD^+$/NADH couple plays a vital role as a reservoir and carrier of reducing equivalents. Ansell, R., et al., *EMBO J.* 16:2179-87 (1997). Cellular glycerol production, which generates an $NAD^+$, serves as a redox valve to remove excess reducing power during anaerobic fermentation in yeast. In addition to functioning as an electron sink, yeast require intracellular glycerol as a compatible solute to balance high extracellular osmolarity.

Glycerol production is, however, an energetically wasteful process that expends ATP and results in the loss of a reduced three-carbon compound. Ansell, R., et al., *EMBO J.* 16:2179-87 (1997). Furthermore, a considerable amount of the glycerol produced by the organism is excreted from the cell where it offers no advantage to the organism. To generate glycerol from a starting glucose molecule, glycerol 3-phosphate dehydrogenase (GPD) reduces dihydroxyacetone phosphate to glycerol 3-phosphate and glycerol 3-phosphatase (GPP) dephosphorylates glycerol 3-phosphate to glycerol. Despite being energetically wasteful, glycerol production is a necessary metabolic process for anaerobic growth as deleting GPD activity completely inhibits growth under anaerobic conditions. See Ansell, R., et al., *EMBO J.* 16:2179-87 (1997).

GPD is encoded by two isogenes, gpd1 and gpd2. GPD1 encodes the major isoform in anaerobically growing cells, while GPD2 is required for glycerol production in the absence of oxygen, which stimulates its expression. Pahlman, A-K., et al., *J. Biol. Chem.* 276:3555-63 (2001). The first step in the conversion of dihydroxyacetone phosphate to glycerol by GPD is rate controlling. Guo, Z. P., et al., *Metab. Eng.* 13:49-59 (2011). GPP is also encoded by two isogenes, gpp1 and gpp2. The deletion of GPP genes arrests growth when shifted to anaerobic conditions, demonstrating that GPP is important for cellular tolerance to osmotic and anaerobic stress. See Pahlman, A-K., et al., *J. Biol. Chem.* 276:3555-63 (2001).

In certain embodiments, one or more genes involved in dihydroxyacetone metabolism are upregulated or over expressed by the recombinant microorganism. In some embodiments the recombinant microorganism overexpresses a dihydroxyacetone kinase, such as DAK1.

Because glycerol is a major by-product of anaerobic production of ethanol, many efforts have been made to delete cellular production of glycerol. However, because of the reducing equivalents produced by glycerol synthesis, deletion of the glycerol synthesis pathway cannot be done without compensating for this valuable metabolic function. Attempts to delete glycerol production and engineer alternate electron acceptors have been made. Lidén, G., et al., *Appl. Env. Microbiol.* 62:3894-96 (1996); Medina, V. G., et al., *Appl. Env. Microbiol.* 76:190-195 (2010). Lidén and Medina both deleted the gpd1 and gpd2 genes and attempted to bypass glycerol formation using additional carbon sources. Lidén engineered a xylose reductase from *Pichia stipitis* into an *S. cerevisiae* gpd1/2 deletion strain. The xylose reductase activity facilitated the anaerobic growth of the glycerol-deleted strain in the presence of xylose. See Lidén, G., et al., *Appl. Env. Microbiol.* 62:3894-96 (1996). Medina engineered an acetylaldehyde dehydrogenase, mhpF, from *E. coli* into an *S. cerevisiae* gpd1/2 deletion strain to convert acetyl-CoA to acetaldehyde. The acetylaldehyde dehydrogenase activity facilitated the anaerobic growth of the glycerol-deletion strain in the presence of acetic acid but not in the presence of glucose as the sole source of carbon. Medina, V. G., et al., *Appl. Env. Microbiol.* 76:190-195 (2010); see also EP 2277989. Medina noted several issues with the mhpF-containing strain that needed to be addressed before implementing industrially, including significantly reduced growth and product formation rates than yeast comprising GPD1 and GPD2.

Additional attempts to redirect flux from glycerol to ethanol have included the engineering of a non-phosphorylating NADP+-dependent glyceraldehydes-3-phosphate dehydrogenase (GAPN) into yeast, either with or without the simultaneous knockout of GPD1. Bro, C., et al., *Metab. Eng.* 8:102-111 (2006); U.S. Patent Appl. Pub. No. US2006/ 0257983; Guo, Z. P., et al., *Metab. Eng.* 13:49-59 (2011). However, other cellular mechanisms exist to control the production and accumulation of glycerol, including glycerol exporters such as FPS1 and the glycerol/$H^+$ symporter STL1, that may not require the engineering of alternate NADP+/NADPH coupling or deletion of glycerol synthesis genes. Tamás, M. J., et al., *Mol. Microbiol.* 31:1087-1004 (1999) and Ferreira, C., et al. (2005).

STL1 is a protein with 12 putative transmembrane domains that functions at the cell membrane as a glycerol/$H^+$ symporter. Yeast cells lacking STL1 are unable to actively uptake glycerol and heterologous expression of *S. cerevisiae* STL1 in *S. pombe* results in glycerol uptake via an active mechanism. Ferreira, C., et al. (2005). In addition, glycerol uptake via STL1 has been shown to be repressed by the presence of glucose through transcriptional repression of the stl1 gene. Conversely, glycerol uptake can be induced by growth on nonfermentable carbon sources and the expression of stl1 is induced under gluconeogenic conditions and by osmotic shock during exponential growth on glucose-based media. Tulha, J., et al. (2010) and Ferreira, C., et al. (2005).

Figure 1:
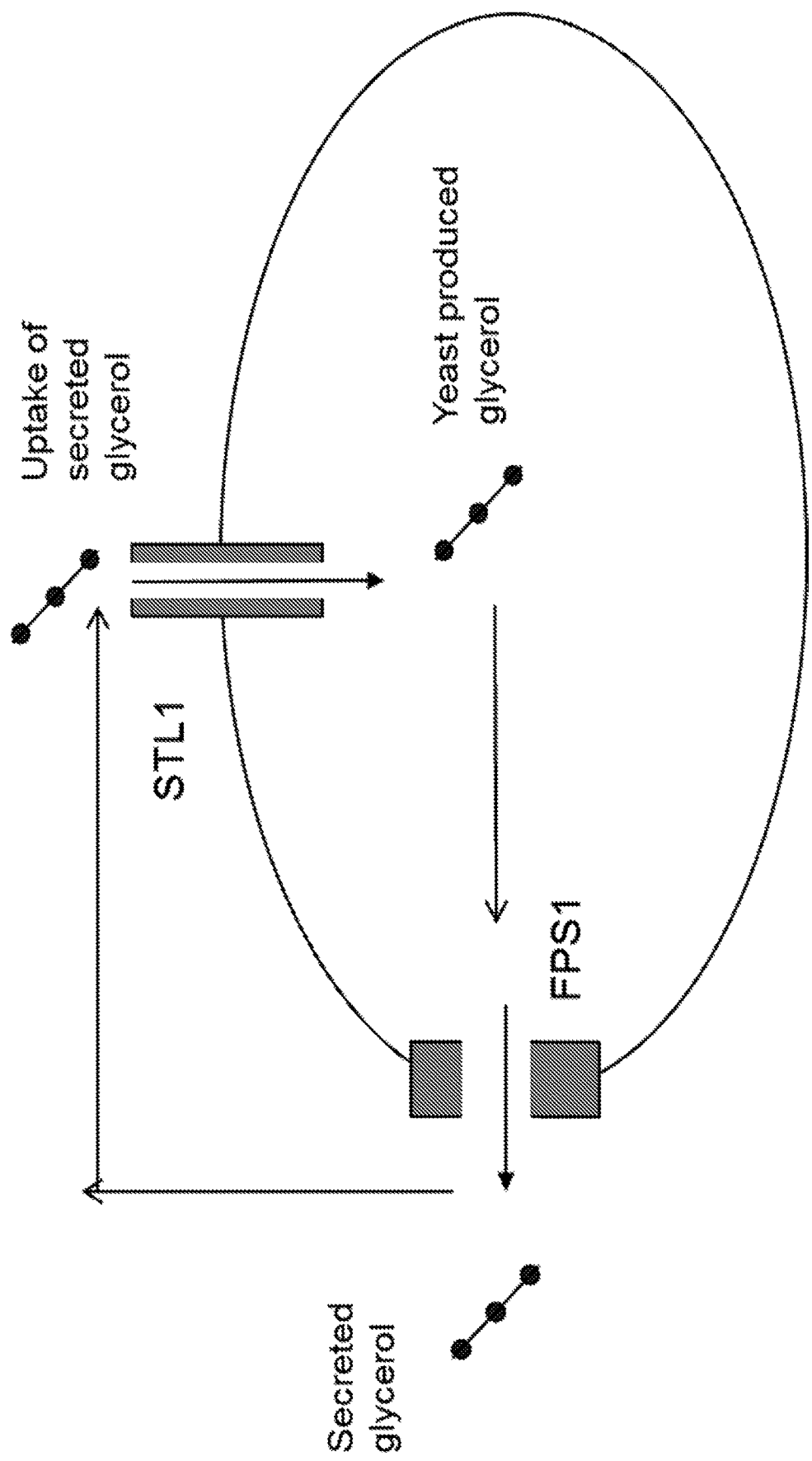
FIG. 1 is an overview of glycerol recycling.

In particular embodiments of the invention that modulate STL1, the recombinant host cells are genetically modified to take up glycerol in the presence of glucose, something which cells cannot normally do. The derepression of glycerol uptake in the presence of glucose results in a three step process. First, glycerol is produced by the organism in response to osmotic or redox stress. Second, glycerol is secreted into the fermentation medium. Finally, glycerol is transported back up into the cell through the action of an active glycerol transporter, for example STL1. The net effect is creation of a futile cycle where glycerol is first excreted and then taken back up (FIG. 1). Without wishing to be bound by any one theory, it is also possible that higher intracellular glycerol levels may function to reduce endogenous glycerol production through feedback inhibition of the native glycerol production machinery. Another embodiment of the invention comprises uptake of glycerol that is exogenously available in the substrate or fermentation medium.

An example STL1 sequence from *S. cerevisiae* is provided in SEQ ID NO: 139 and SEQ ID NO: 140. In some embodiments, STL1 is from *C. albicans*. *C. albicans* STL1 nucleotide and amino acid sequences correspond to SEQ ID NO: 141 and SEQ ID NO: 142, respectively. In some embodiments, STL1 is from *Pichia sorbitophila*. *P. sorbitophila* STL1 nucleotide and amino acid sequences correspond to SEQ ID NO: 9 and SEQ ID NO: 10, respectively. In certain embodiments, STL1 is from *Saccharomyces paradoxus*. *S. paradoxus* STL1 nucleotide and amino acid sequences correspond to SEQ ID NO: 224 and SEQ ID NO: 225, respectively.

An additional protein that may be involved in glycerol regulation is encoded by the *S. cerevisiae* gene GUP1. Although the role of GUP1 in glycerol regulation is unclear, overexpression of GUP1 in *S. cerevisiae* has been shown to result in increased ethanol production. See Yu, K. O., et al., "Engineering of glycerol utilization pathway for ethanol production by *Saccharomyces cerevisiae*," Bioresour. Technol. 101(11):157-61 (2010) and International Publication No. WO 2011/149353, which are incorporated by reference herein in their entireties.

*S. cerevisiae* GUP1 nucleotide and amino acid sequences correspond to SEQ ID NO: 11 and SEQ ID NO: 12, respectively. In some embodiments of the invention, STL1 and GUP1 are modulated in the same recombinant microorganism. In certain embodiments of the invention, STL1 and GUP1 are overexpressed in the same recombinant microorganism.

FPS1 is a channel protein located in the plasma membrane that controls the accumulation and release of glycerol in yeast osmoregulation. Null mutants of this strain accumulate large amounts of intracellular glycerol, grow much slower than wild-type, and consume the sugar substrate at a slower rate. Tamás, M. J., et al., *Mol. Microbiol.* 31:1087-1004 (1999). Despite slower growth under anaerobic conditions, an fps1Δ strain can serve as an alternative to eliminating NAD+-dependent glycerol activity. An fps1Δ strain has reduced glycerol formation yet has a completely functional NAD+-dependent glycerol synthesis pathway. Alternatively, rather than deleting endogenous FPS1, constitutively active mutants of FPS1 (fps1-1) or homologs from other organisms can be used to regulate glycerol synthesis while keeping the NAD+-dependent glycerol activity intact. In embodiments of the invention that modulate STL1 and FPS1, the recombinant host cells can still synthesize and retain glycerol and achieve improved robustness relative to strains that are unable to make or eliminate glycerol.

An example FPS1 sequence from *S. cerevisiae* is provided in SEQ ID NO: 13 and SEQ ID NO: 14. Sequence for a constitutively active FPS1 from *S. cerevisiae* is provided in SEQ ID NO:15 and SEQ ID NO:16.

Table 2 provides exemplary genes involved in glycerol reduction that can be engineered as indicated in the recombinant microorganisms of the invention:

TABLE 2

| Gene Name | Modification | Systematic name | Gene Source | SEQ ID NO (DNA/Protein) |
|---|---|---|---|---|
| FDH1 | Deletion | YOR388C | *S. cerevisiae* PE-2 | 199/200 |
| FDH2 | Deletion | YPL275W/YPL276W | *S. cerevisiae* S288C | 201/202, 203 |
| GPD2 | Deletion | YOL059W | *S. cerevisiae* PE-2 | 204/205 |
| GPD1 | Deletion | YDL022W | *S. cerevisiae* PE-2 | 206/207 |
| FCY1 | Deletion/ Integration site | YPR062W | *S. cerevisiae* PE-2 | 208/209 |
| YLR296W | Deletion/ Integration site | YLR296W | *S. cerevisiae* PE-2 | 210/211 |

TABLE 2-continued

| Gene Name | Modification | Systematic name | Gene Source | SEQ ID NO (DNA/Protein) |
|---|---|---|---|---|
| STL1 | Overexpression | YDR536W | S. cerevisiae M2390 | 212/213 |
| GCY1 | Overexpression | YOR120W | S. cerevisiae M2390 | 214/215 |
| DAK1 | Overexpression | YML070W | S. cerevisiae M2390 | 216/217 |
| AdhE | Overexpression | NA | Bifidobacterium adolescentis (codon optimized) | 218/219 |
| PflA | Overexpression | NA | Bifidobacterium adolescentis (codon optimized) | 220/221 |
| PflB | Overexpression | NA | Bifidobacterium adolescentis (codon optimized) | 222/223 |

Pyruvate Formate Lyase (PFL)

The conversion of the pyruvate to acetyl-CoA and formate is performed by pyruvate formate lyase (PFL). In E. coli, PFL is the primary enzyme responsible for the production of formate. PFL is a dimer of PflB that requires the activating enzyme PflAE, which is encoded by pflA, radical S-adenosylmethionine, and a single electron donor. See Waks, Z., and Silver, P. A., Appl. Env. Microbiol. 75:1867-1875 (2009). Waks and Silver engineered strains of S. cerevisiae to secrete formate by the addition of PFL and AdhE from E. coli and deletion of endogenous formate dehydrogenases and to produce hydrogen in a two-step process using E. coli. Waks and Silver, however, did not combine formate production with the removal of glycerol formation, and the use of formate as an alternate electron acceptor for the reduction of glycerol was not proposed or evaluated.

PFL enzymes for use in the recombinant host cells of the invention can come from a bacterial or eukaryotic source. Examples of bacterial PFL include, but are not limited to, Bacillus licheniformis DSM13, Bacillus licheniformis ATCC14580, Streptococcus thermophilus CNRZ1066, Streptococcus thermophilus LMG18311, Streptococcus thermophilus LMD-9, Lactobacillus plantarum WCFS1 (Gene Accession No. lp_2598), Lactobacillus plantarum WCFS1 (Gene Accession No. lp_3313), Lactobacillus plantarum JDM1 (Gene Accession No. JDM1_2695), Lactobacillus plantarum JDM1 (Gene Accession No. JDM1_2087), Lactobacillus casei b123, Lactobacillus casei ATCC 334, Bifidobacterium adolescentis, Bifidobacterium longum NCC2705, Bifidobacterium longum DJO10A, Bifidobacterium animalis DSM 10140, Clostridium cellulolyticum, or Escherichia coli. Additional PFL enzymes may be from the PFL1 family, the RNR pfl superfamily, or the PFL2 superfamily.

pflA sequences from bacteria include: Bacillus licheniformis DSM13 (SEQ ID NOs:17 and 18); Bacillus licheniformis ATCC14580 (SEQ ID NOs:19 and 20);

Streptococcus thermophilus CNRZ1066 (SEQ ID NOs:21 and 22); Streptococcus thermophilus LMG18311 (SEQ ID NOs:23 and 24); Streptococcus thermophilus LMD-9 (SEQ ID NOs:25 and 26); Lactobacillus plantarum WCFS1 (Gene Accession No: lp_2596) (SEQ ID NOs:27 and 28); Lactobacillus plantarum WCFS1 (Gene Accession No: lp_3314) (SEQ ID NOs:29 and 30); Lactobacillus plantarum JDM1 (Gene Accession No: JDM1_2660) (SEQ ID NOs:31 and 32) Lactobacillus plantarum JDM1 (Gene Accession No: JDM1_2085) (SEQ ID NOs:33 and 34); Lactobacillus casei b123 (SEQ ID NOs:35 and 36); Lactobacillus casei ATCC 334 (SEQ ID NOs:37 and 38); Bifidobacterium adolescentis (SEQ ID NOs:39 and 40); Bifidobacterium longum NCC2705 (SEQ ID NOs:41 and 42); Bifidobacterium longum DJO10A (SEQ ID NOs:43 and 44); Bifidobacterium animalis DSM 10140 (SEQ ID NOs:45 and 46); Clostridium cellulolyticum (SEQ ID NOs:47 and 48); Escherichia coli (SEQ ID NOs:49 and 50);

pflB sequences from bacteria include: Bacillus licheniformis DSM13 (SEQ ID NOs:51 and 52); Bacillus licheniformis ATCC14580 (SEQ ID NOs:53 and 54);

Streptococcus thermophilus CNRZ1066 (SEQ ID NOs:55 and 56); Streptococcus thermophilus LMG18311 (SEQ ID NOs:57 and 58); Streptococcus thermophilus LMD-9 (SEQ ID NOs:59 and 60); Lactobacillus plantarum WCFS1 (Gene Accession No. lp_2598) (SEQ ID NOs:61 and 62); Lactobacillus plantarum WCFS1 (Gene Accession No: lp_3313) (SEQ ID NOs:63 and 64); Lactobacillus plantarum JDM1 (Gene Accession No: JDM1_2695) (SEQ ID NOs:65 and 66); Lactobacillus plantarum JDM1 (Gene Accession No: JDM1_2087) (SEQ ID NOs:67 and 68); Lactobacillus casei b123 (SEQ ID NOs:69 and 70); Lactobacillus casei ATCC 334 (SEQ ID NOs:71 and 72); Bifidobacterium adolescentis (SEQ ID NOs:73 and 74); Bifidobacterium longum NCC2705 (SEQ ID NOs:75 and 76); Bifidobacterium longum DJO10A (SEQ ID NOs:77 and 78); Bifidobacterium animalis DSM 10140 (SEQ ID NOs:79 and 80); Clostridium cellulolyticum (SEQ ID NOs:81 and 82); Escherichia coli (SEQ ID NOs:83 and 84);

Examples of eukaryotic PFL include, but are not limited to, Chlamydomonas reinhardtii PflA1, Piromyces sp. E2, or Neocallimastix frontalis, Acetabularia acetabulum, Haematococcus pluvialis, Volvox carteri, Ostreococcus tauri, Ostreococcus lucimarinus, Micromonas pusilla, Micromonas sp., Porphyra haitanensis, and Cyanophora paradoxa), an opisthokont (Amoebidium parasiticum), an amoebozoan (Mastigamoeba balamuthi), a stramenopile (Thalassiosira pseudonana (2)) and a haptophyte (Prymnesium parvum), M. pusilla, Micromonas sp. O. tauri and O. lucimarinus) an amoebozoan (M. balamuthi), and a stramenopile (T. pseudonana). See Stairs, C. W., et al., "Eukaryotic pyruvate formate lyase and its activating enzyme were acquired laterally from a firmicute," Mol. Biol. and Evol., published on-line on Feb. 3, 2011, at http://mbe.oxfordjournals.org/.

pflA sequences from eukaryotes include: Chlamydomonas reinhardtii PflA1 (SEQ ID NOs:85 and 86); Neocallimastix frontalis (SEQ ID NOs:87 and 88);

pfl1 sequences from eukaryotes include: Chlamydomonas reinhardtii PflA (SEQ ID NOs:89 and 90); Piromyces sp. E2

(SEQ ID NOs:91 and 92); *Neocallimastix frontalis* (nucleotide—partial CDS, missing start; SEQ ID NO:93); and *Neocallimastix frontalis* (amino acid—partial CDS, missing start; SEQ ID NO:94).

In certain embodiments, the recombinant microorganism comprises a deletion or disruption of one or more formate dehydrogenase genes. FDH sequences from eukaryotes include: *S. cerevisiae* fdh1 (SEQ ID NOs: 199 and 200) and *S. cerevisiae* fdh2 (SEQ ID NOs: 201 and 202). In some embodiments, the one or more pyruvate dehydrogenase genes are selected from FDH1, FDH2, or both.

Acetaldehyde/Alcohol Dehydrogenases

Engineering of acetaldehyde dehydrogenases, alcohol dehydrogenases, and/or bifunctional acetylaldehyde/alcohol dehydrogenases into a cell can increase the production of ethanol. However, because the production of ethanol is redox neutral, an acetaldehyde/alcohol dehydrogenase activity cannot serve as an alternative for the redox balancing that the production of glycerol provides to a cell in anaerobic metabolism. When Medina attempted to express an acetylaldehyde dehydrogenase, mhpF, from *E. coli* in an *S. cerevisiae* gpd1/2 deletion strain, the strain did not grow under anaerobic conditions in the presence of glucose as the sole source of carbon. Medina, V. G., et al., *Appl. Env. Microbiol.* 76:190-195 (2010); see also EP 2277989. Rather, the anaerobic growth of the glycerol-deletion strain required the presence of acetic acid. However, an acetylaldehyde dehydrogenase has not been expressed in combination with PFL or with the recombinant host cells of the invention. Additionally, replacing the endogenous acetylaldehyde dehydrogenase activity with either an improved acetaldehyde dehydrogenase or using a bifunctional acetaldehyde/alcohol dehydrogenase (AADH) can positively affect the in vivo kinetics of the reaction providing for improved growth of the host strain.

AADH enzymes for use in the recombinant host cells of the invention can come from a bacterial or eukaryotic source. Examples of bacterial AADH include, but are not limited to, *Clostridium phytofermentans, Escherichia coli, Bacillus coagulans, Bacillus lentus, Bacillus licheniformis, Bacillus pumilus, Bacillus subtilis, Bacteroides amylophilus, Bacteroides capillosus, Bacteroides ruminocola, Bacteroides suis, Bifidobacterium adolescentis, Bifidobacterium animalis, Bifidobacterium bifidum, Bifidobacterium infantis, Bifidobacterium longum, Bifidobacterium thermophilum, Lactobacillus acidophilus, Lactobacillus brevis, Lactobacillus buchneri* (cattle only), *Lactobacillus bulgaricus, Lactobacillus casei, Lactobacillus cellobiosus, Lactobacillus curvatus, Lactobacillus delbruekii, Lactobacillus farciminis* (swine only), *Lactobacillus fermentum, Lactobacillus helveticus, Lactobacillus lactis, Lactobacillus plantarum, Lactobacillus reuterii, Leuconostoc mesenteroides, Pediococcus acidilacticii, Pediococcus pentosaceus, Propionibacterium acidpropionici* (cattle only), *Propionibacterium freudenreichii, Propionibacterium shermanii, Enterococcus cremoris, Enterococcus diacetylactis, Enterococcus faecium, Enterococcus intermedius, Enterococcus lactis,* or *Enterococcus thermophilus*

AdhE bacterial sequences include: *Clostridium phytofermentans* (SEQ ID NOs:95 and 96); *Escherichia coli* (SEQ ID NOs:97 and 98); *Bifidobacterium adolescentis* (amino acid; SEQ ID NO:103); *Bacillus coagulans* (amino acid; SEQ ID NO:104); *Bacillus licheniformis* (amino acid; SEQ ID NO: 105); *Enterococcus faecium* TX1330 (amino acid; SEQ ID NO:106);

Examples of eukaryotic AdhE include, but are not limited to, *Chlamydomonas reinhardtii* AdhE, *Piromyces* sp. E2, or *Neocallimastix frontalis*. AdhE sequences from eukaryotes include: *Chlamydomonas reinhardtii* AdhE (SEQ ID NOs: 99 and 100) and *Piromyces* sp. E2 (SEQ ID NOs: 101 and 102).

The recombinant microorganism of the present invention can be capable of overexpressing one or more alcohol dehydrogenases. In some embodiments, the recombinant host cell overexpresses AdhE. In one particular embodiment, the AdhE is from *B. adolescentis*.

Consolidated Bioprocessing

Consolidated bioprocessing (CBP) is a processing strategy for cellulosic biomass that involves consolidating into a single process step four biologically-mediated events: enzyme production, hydrolysis, hexose fermentation, and pentose fermentation. Implementing this strategy requires development of microorganisms that both utilize cellulose, hemicellulosics, and other biomass components while also producing a product of interest at sufficiently high yield and concentrations. The feasibility of CBP is supported by kinetic and bioenergetic analysis. See van Walsum and Lynd (1998) *Biotech. Bioeng.* 58:316.

CBP offers the potential for lower cost and higher efficiency than processes featuring dedicated saccharolytic enzyme production. The benefits result in part from avoided capital costs, substrate and other raw materials, and utilities associated with saccharolytic enzyme production. In addition, several factors support the realization of higher rates of hydrolysis, and hence reduced reactor volume and capital investment using CBP, including enzyme-microbe synergy and the use of thermophilic organisms and/or complexed saccharolytic systems. Moreover, cellulose-adherent cellulolytic microorganisms are likely to compete successfully for products of cellulose hydrolysis with non-adhered microbes, e.g., contaminants, which could increase the stability of industrial processes based on microbial cellulose utilization. Progress in developing CBP-enabling microorganisms is being made through two strategies: engineering naturally occurring saccharolytic microorganisms to improve product-related properties, such as yield and titer; and engineering non-saccharolytic organisms that exhibit high product yields and titers to express a heterologous saccharolytic enzyme system enabling starch, cellulose, and, hemicellulose utilization.

Starch and Cellulose Degradation

The degradation of starch into component sugar units proceeds via amylolytic enzymes. Amylase is an example of an amylolytic enzyme that is present in human saliva, where it begins the chemical process of digestion. The pancreas also makes amylase (alpha amylase) to hydrolyze dietary starch into disaccharides and trisaccharides which are converted by other enzymes to glucose to supply the body with energy. Plants and some bacteria also produce amylases. Amylases are glycoside hydrolases and act on α-1,4-glycosidic bonds.

Several amylolytic enzymes are implicated in starch hydrolysis. Alpha-amylases (EC 3.2.1.1) (alternate names: 1,4-α-D-glucan glucanohydrolase; glycogenase) are calcium metalloenzymes, i.e., completely unable to function in the absence of calcium. By acting at random locations along the starch chain, alpha-amylase breaks down long-chain carbohydrates, ultimately yielding maltotriose and maltose from amylose, or maltose, glucose and "limit dextrin" from amylopectin. Because it can act anywhere on the substrate, alpha-amylase tends to be faster-acting than beta-amylase. Another form of amylase, beta-amylase (EC 3.2.1.2) (alternate names: 1,4-α-D-glucan maltohydrolase; glycogenase; saccharogen amylase) catalyzes the hydrolysis of the second α-1,4 glycosidic bond, cleaving off two glucose units (maltose) at a time. The third amylase is gamma-amylase (EC 3.2.1.3) (alternate names: Glucan 1,4-α-glucosidase; amyloglucosidase; Exo-1,4-α-glucosidase; glucoamylase; lysosomal α-glucosidase; 1,4-α-D-glucan glucohydrolase). In addition to cleaving the last α(1-4)glycosidic linkages at the nonreducing end of amylose and amylopectin, yielding glucose, gamma-amylase will cleave α(1-6) glycosidic linkages.

A fourth enzyme, alpha-glucosidase, acts on maltose and other short malto-oligosaccharides produced by alpha-, beta-, and gamma-amylases, converting them to glucose.

Three major types of enzymatic activities degrade native cellulose. The first type is endoglucanases (1,4-β-D-glucan 4-glucanohydrolases; EC 3.2.1.4). Endoglucanases cut at random in the cellulose polysaccharide chain of amorphous cellulose, generating oligosaccharides of varying lengths and consequently new chain ends. The second type are exoglucanases, including cellodextrinases (1,4-β-D-glucan glucanohydrolases; EC 3.2.1.74) and cellobiohydrolases (1,4-β-D-glucan cellobiohydrolases; EC 3.2.1.91). Exoglucanases act in a processive manner on the reducing or non-reducing ends of cellulose polysaccharide chains, liberating either glucose (glucanohydrolases) or cellobiose (cellobiohydrolase) as major products. Exoglucanases can also act on microcrystalline cellulose, presumably peeling cellulose chains from the microcrystalline structure. The third type are β-glucosidases (β-glucoside glucohydrolases; EC 3.2.1.21). β-Glucosidases hydrolyze soluble cellodextrins and cellobiose to glucose units.

Even though yeast strains expressing enzymes for the production of fuel ethanol from whole grain or starch have been previously disclosed, the application has not been commercialized in the grain-based fuel ethanol industry, due to the relatively poor ability of the resulting strains to produce/tolerate high levels of ethanol. For example, U.S. Pat. No. 7,226,776 discloses that a polysaccharase enzyme expressing ethanologen can make ethanol directly from carbohydrate polymers, but the maximal ethanol titer demonstrated is 3.9 g/L. U.S. Pat. No. 5,422,267 discloses the use of a glucoamylase in yeast for production of alcoholic beverages; however, no commercially relevant titers of ethanol are disclosed.

Heterologous Saccharolytic Enzymes

According to one aspect of the present invention, the expression of heterologous saccharolytic enzymes the recombinant microorganisms of the invention can be used advantageously to produce products such as ethanol from biomass sources. For example, cellulases from a variety of sources can be heterologously expressed to successfully increase efficiency of ethanol production. The saccharolytic enzymes can be from fungi, yeast, bacteria, plant, protozoan or termite sources. In some embodiments, the saccharolytic enzyme is from *H. grisea, T. aurantiacus, T. emersonii, T. reesei, C. lacteus, C. formosanus, N. takasagoensis, C. acinaciformis, M. darwinensis, N. walkeri, S. fibuligera, C. lucknowense R. speratus, Thermobfida fusca, Clostridum thermocellum, Clostridium cellulolyticum, Clostridum josui, Bacillus pumilis, Cellulomonas fimi, Saccharophagus degradans, Piromyces equii, Neocallimastix patricarum* or *Arabidopsis thaliana*.

In some embodiments, the cellulase for expression in the recombinant microorganisms of the invention is any cellulase disclosed in Table 4 or Table 7 in International Publication No. WO2011/153516, incorporated by reference herein in its entirety, or any cellulase suitable for expression in an appropriate host cell. In other embodiments, the amylase for expression in the recombinant microorganisms of the invention is any amylase such as alpha-amylases, beta-amylases, glucoamylases, alpha-glucosidases, pullulanase, or isopullulanase paralogues or orthologues, any amylase disclosed in Tables 15-19, preferably in Table 19, in International Publication No. WO2011/153516, incorporated by reference herein in its entirety, or any amylase suitable for expression in an appropriate host cell. In some embodiments of the invention, multiple saccharolytic enzymes from a single organism are co-expressed in the same recombinant microorganism. In some embodiments of the invention, multiple saccharolytic enzymes from different organisms are co-expressed in the same recombinant microorganism. In particular, saccharolytic enzymes from two, three, four, five, six, seven, eight, nine or more organisms can be co-expressed in the same recombinant microorganism. Similarly, the invention can encompass co-cultures of yeast strains, wherein the yeast strains express different saccharolytic enzymes. Co-cultures can include yeast strains expressing heterologous saccharolytic enzymes from the same organisms or from different organisms. Co-cultures can include yeast strains expressing saccharolytic enzymes from two, three, four, five, six, seven, eight, nine or more organisms.

Lignocellulases for expression in the recombinant microorganisms of the present invention include both endoglucanases and exoglucanases. Other lignocellulases for expression in the recombinant microorganisms of the invention include accessory enzymes which can act on the lignocellulosic material. The lignocellulases can be, for example, endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, and feruoyl esterases. In some embodiments, the lignocellulases of the invention can be any suitable enzyme for digesting the desired lignocellulosic material.

In certain embodiments of the invention, the lignocellulase can be an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, and feruoyl esterase paralogue or orthologue. In particular embodiments, the lignocellulase is derived from any species named in Tables 4 and 7, in copending International Publication No. WO2011/153516, incorporated by reference herein.

Xylose Metabolism

Xylose is a five-carbon monosaccharide that can be metabolized into useful products by a variety of organisms. There are two main pathways of xylose metabolism, each unique in the characteristic enzymes they utilize. One pathway is called the "Xylose Reductase-Xylitol Dehydrogenase" or XR-XDH pathway. Xylose reductase (XR) and xylitol dehydrogenase (XDH) are the two main enzymes used in this method of xylose degradation. XR, encoded by the XYL1 gene, is responsible for the reduction of xylose to xylitol and is aided by cofactors NADH or NADPH. Xylitol is then oxidized to xylulose by XDH, which is expressed through the XYL2 gene, and accomplished exclusively with the cofactor $NAD^+$. Because of the varying cofactors needed in this pathway and the degree to which they are available for usage, an imbalance can result in an overproduction of xylitol byproduct and an inefficient production of desirable ethanol. Varying expression of the XR and XDH enzyme levels have been tested in the laboratory in the attempt to optimize the efficiency of the xylose metabolism pathway.

The other pathway for xylose metabolism is called the "Xylose Isomerase" (XI) pathway. Enzyme XI is responsible for direct conversion of xylose into xylulose, and does not proceed via a xylitol intermediate. Both pathways create xylulose, although the enzymes utilized are different. After production of xylulose both the XR-XDH and XI pathways proceed through the enzyme xylulokinase (XK), encoded on gene XKS1, to further modify xylulose into xylulose-5-phosphate where it then enters the pentose phosphate pathway for further catabolism. XI includes those enzymes that correspond to Enzyme Commission Number 5.3.1.5. Suitable xylose isomerases of the present invention include xylose isomerases derived from, for example, *Piromyces* sp., and *B. thetaiotaomicron*, although any xylose isomerase that functions when expressed in host cells of the invention can be used, including chimeric enzymes.

*Piromyces* sp. xylose isomerase nucleotide and amino acid sequences correspond to SEQ ID NO:107 and SEQ ID NO:108, respectively. *B. thetaiotaomicron* xylose isomerase nucleotide and amino acid sequences correspond to SEQ ID NO:109 and SEQ ID NO:110, respectively.

Studies on flux through the pentose phosphate pathway during xylose metabolism have revealed that limiting the speed of this step may be beneficial to the efficiency of fermentation to ethanol. Modifications to this flux that may improve ethanol production include a) lowering phosphoglucose isomerase activity, b) deleting the GND1 gene, and c) deleting the ZWF1 gene (Jeppsson et al., *Appl. Environ. Microbiol.* 68:1604-09 (2002)). Since the pentose phosphate pathway produces additional NADPH during metabolism, limiting this step will help to correct the already evident imbalance between NAD(P)H and NAD$^+$ cofactors and reduce xylitol byproduct. In an additional embodiment, a native and/or heterologous phosphoketolase, an enzyme that participates in the PPP pathway, may be expressed in a recombinant microorganism of the invention. Phosphoketolases include enzymes that catalyze the conversion of D-xylulose 5-phosphate to D-glyceraldehyde 3-phosphate and dual specificity phosphoketolases that catalyze the conversion of D-fructose 6-phosphate to D-erythrose 4-phosphate. Phosphoketolases that can be employed in the invention include those disclosed in commonly owned U.S. Provisional Patent Application Nos. 61/728,450 and 61/792,731, which are incorporated by reference herein in their entireties.

An alternative approach is to improve the kinetics of the oxidative branch of the PPP over those of competing pathways. This could be achieved by various approaches, e.g., by directly increasing the expression of the rate-limiting enzyme(s) of the oxidative branch of the PPP pathway, such as glucose-6-P dehydrogenase (encoded endogenously by ZWF1), changing the expression of regulating transcription factors like Stb5p (Cadière, A., et al., "The *Saccharomyces cerevisiae* zinc factor protein Stb5p is required as a basal regulator of the pentose phosphate pathway," *FEMS Yeast Research* 10:819-827 (2010)), or directly down-regulating the expression of genes involved in competing pathways like glucose-6-P isomerase (encoded by PGI1). Producing more $CO_2$ in the oxidative branch of the PPP would increase the availability of NADPH and increase the NADPH/NADP ratio. This would stimulate the flux of acetate-consuming pathways that (at least partially) consume NADPH, as would for example be the case for ethanol-to-isopropanol conversion that relies on a NADPH-consuming secondary alcohol dehydrogenase to convert acetone to isopropanol, or an acetate-to-ethanol pathway that uses a NADPH-consuming acetaldehyde dehydrogenase and/or alcohol dehydrogenase.

Another experiment comparing the two xylose metabolizing pathways revealed that the XI pathway was best able to metabolize xylose to produce the greatest ethanol yield, while the XR-XDH pathway reached a much faster rate of ethanol production (Karhumaa et al., *Microb Cell Fact.* 2007 Feb. 5, 6:5). See also International Publication No. WO2006/009434, incorporated herein by reference in its entirety.

In some embodiments, the recombinant microorganisms of the invention have the ability to metabolize xylose using one or more of the above enzymes.

Various genes involved in xylose metabolism may be overexpressed by the recombinant microorganisms of the present invention. In some embodiments, the recombinant microorganism overexpresses one or more of xylose isomerase (XylA), xylulokinase (XKS1), transketolase (TKL2), transaldolase (TAL1), ribose-5-phosphate ketolisomerase (RKI1) and any combination thereof. Table 3 provides exemplary genes involved in xylose metabolism that can be engineered, as indicated, in the recombinant microorganisms of the invention:

TABLE 3

| Gene name | Modification | Organism | SEQ ID NO |
| --- | --- | --- | --- |
| TAL1 | Overexpression | Saccharomyces cerevisiae | 226 |
| XKS1 | Overexpression | Saccharomyces cerevisiae | 227 |
| TKL1 | Overexpression | Saccharomyces cerevisiae | 228 |
| RKI1 | Overexpression | Saccharomyces cerevisiae | 229 |
| BtXI | Overexpression | Bacteroides thetaiotaomicron | 109 |

Arabinose Metabolism

Arabinose is a five-carbon monosaccharide that can be metabolized into useful products by a variety of organisms. L-Arabinose residues are found widely distributed among many heteropolysaccharides of different plant tissues, such as arabinans, arabinogalactans, xylans and arabinoxylans. *Bacillus* species in the soil participate in the early stages of plant material decomposition, and *B. subtilis* secretes three enzymes, an endo-arabanase and two arabinosidases, capable of releasing arabinosyl oligomers and L-arabinose from plant cell.

Three pathways for L-arabinose metabolism in microorganisms have been described. Many bacteria, including *Escherichia coli*, use arabinose isomerase (AraA; E.C. 5.3.1.4), ribulokinase (AraB; E.C. 2.7.1.16), and ribulose phosphate epimerase (AraD; E.C. 5.1.3.4) to sequentially convert L-arabinose to D-xylulose-5-phosphate through L-ribulose and L-ribulose 5-phosphate. See, e.g., Sa-Nogueira I, et al., Microbiology 143:957-69 (1997). The D-xylulose-5-phosphate then enters the pentose phosphate pathway for further catabolism. In the second pathway, L-arabinose is converted to L-2-keto-3-deoxyarabonate (L-KDA) by the consecutive action of enzymes arabinose dehydrogenase (ADH), arabinolactone (AL), and arabinonate dehydratase (AraC). See, e.g., Watanabe, S, et al., *J. Biol. Chem.* 281: 2612-2623 (2006). L-KDA can be further metabolized in two alternative pathways: 1) L-KDA conversion to 2-ketoglutarate via 2-ketoglutaric semialdehyde (KGSA) by L-KDA dehydratase and KGSA dehydrogenase or 2) L-KDA conversion to pyruvate and glycolaldehyde by L-KDA aldolase. In the third, fungal pathway, L-arabinose is converted to D-xylulose-5-phosphate through L-arabinitol, L-xylulose, and xylitol, by enzymes such as NAD(P)H-dependent aldose reductase (AR), L-arabinitol 4-dehydrogenase (ALDH), L-xylulose reductase (LXR), xylitol dehydrogenase (XylD), and xylulokinase (XylB). These, and additional proteins involved in arabinose metabolism and regulation may be found at http://www.nmpdr.org/FIG/subsys.cgi?user=&ssa_name=L-Arabinose utilization&request=show_ssa, visited Jun. 20, 2013, which is incorporated by reference herein in its entirety.

AraC protein regulates expression of its own synthesis and the other genes of the Ara system. See Schleif, R., *Trends Genet.* 16(12):559-65 (2000). In the *E. coli*, the AraC protein positively and negatively regulates expression of the proteins required for the uptake and catabolism of the sugar L-arabinose. Homologs of AraC, such as regulatory proteins RhaR and RhaS of the rhamnose operon, have been identified that contain regions homologous to the DNA-binding domain of AraC (Leal, T. F. and de Sa-Nogueira, I., *FEMS Microbiol Lett.* 241(1):41-48 (2004)). Such arabinose regulatory proteins are referred to as the AraC/XylS family. See also, Mota, L. J., et al., *Mol. Microbiol.* 33(3):476-89 (1999); Mota, L. J., et al., *J Bacteriol.* 183(14):4190-201 (2001).

In *E. coli*, the transport of L-arabinose across the *E. coli* cytoplasmic membrane requires the expression of either the high-affinity transport operon, araFGH, a binding protein-dependent system on the low-affinity transport operon, araE, a proton symporter. Additional arabinose transporters include those identified from *K. marxianus* and *P. guilliermondii*, disclosed in U.S. Pat. No. 7,846,712, which is incorporated by reference herein.

In some embodiments, the recombinant microorganisms of the invention have the ability to metabolize arabinose using one or more of the above enzymes. Additional enzymes and/or strategies that can be employed for the metabolism of arabinose in the invention include those disclosed in commonly owned International Publication No. WO 2013/071112, which is incorporated by reference herein in its entirety.

Trehalose Metabolism

Trehalose is an alpha-linked disaccharide formed through an α,α-1,1-glucoside bond between two α-glucose molecules. Trehalose is known to play a role as a storage carbohydrate in yeast and can be broken down into glucose by enzymes such as trehalase. Intracellular levels of trehalose in the yeast *S. cerevisiae* are well-regulated through balancing enzymatic synthesis and degradation. See Jules, M., et al., "New Insights into Trehalose Metabolism by *Saccharomyces cerevisiae*: NHT2 Encodes a Functional Cytosolic Trehalase, and Deletion of TPS1 Reveals ATH1p-Dependent Trehalose Mobilization," *Appl. Environ. Microbiol.* 74(3):605-614 (2008). Trehalose also functions as a potential carbon source for microorganisms, including yeast. Yeast genes involved in the metabolism of trehalose include, but are not limited to, Ath1p, which is thought to extracellularly hydrolyze trehalose into two glucose units; the trehalose transporter Agt1p; and Nth1p, which is believed to hydrolyse the imported disaccharide. See Jules, M., et al. (2008).

In some embodiments, the recombinant microorganisms of the invention have the ability to metabolize trehalose using one or more of the above enzymes. Additionally, over expression of TPS1 and/or TPS2, and/or TSL1 may increase the intracellular pool of trehalose allowing for improved robustness. It was recently shown that overexpression of TPS1 and TPS2 improved the performance of a GPD1 mutant engineered to express GAPN from *Bacillus cereus*. See Guo, Z-P., et al., "Minimization of glycerol synthesis in industrial ethanol yeast without influencing its fermentation performance," *Metabolic Engineering* 13(1):49-59 (2011). It has not been shown that overexpression of trehalose synthesis improves the performance of strains engineered to make formate nor has it been shown in combination with glycerol uptake genes such as STL1. In some embodiments TPS1 is from *S. cerevisiae*. *S. cerevisiae* TPS1 nucleotide and amino acid sequences correspond to SEQ ID NO:111 and SEQ ID NO:112, respectively. In some embodiments TPS2 is from *S. cerevisiae*. *S. cerevisiae* TPS2 nucleotide and amino acid sequences correspond to SEQ ID NO:113 and SEQ ID NO:114, respectively. In some embodiments TSL1 is from *S. cerevisiae*. *S. cerevisiae* TSL1 nucleotide and amino acid sequences correspond to SEQ ID NO:115 and SEQ ID NO:116, respectively. In some embodiments NTH1 is from *S. cerevisiae*. *S. cerevisiae* NTH1 nucleotide and amino acid sequences correspond to SEQ ID NO:117 and SEQ ID NO:118, respectively.

Isopropanol Production

Production of isopropanol from carbohydrates has been shown to occur natively in certain organisms including those related to *C. acetobutylicum*. In addition, pathways for the recombinant production of isopropanol from carbohydrates in microorganisms have been engineered in *E. coli* and yeast. See, e.g., U.S. Patent Appl. Pub. No. 2008/0293125, which is incorporated by reference herein in its entirety. Additional methods and enzymes for recombinantly producing isopropanol are disclosed in commonly owned International Publication No. WO 2011/140386, which is incorporated by reference herein in its entirety. In certain embodiments, any of the above pathways may be engineered into the recombinant microorganism of the invention for the production of isopropanol.

Microorganisms

The present invention includes multiple strategies for the development of microorganisms with the combination of substrate-utilization and product-formation properties required for CBP. The "native cellulolytic strategy" involves engineering naturally occurring cellulolytic microorganisms to improve product-related properties, such as yield and titer. The "recombinant cellulolytic strategy" involves engineering natively non-cellulolytic organisms that exhibit high product yields and titers to express a heterologous cellulase system that enables cellulose utilization or hemicellulose utilization or both.

Many bacteria have the ability to ferment simple hexose sugars into a mixture of acidic and pH-neutral products via the process of glycolysis. The glycolytic pathway is abundant and comprises a series of enzymatic steps whereby a six carbon glucose molecule is broken down, via multiple intermediates, into two molecules of the three carbon compound pyruvate. This process results in the net generation of ATP (biological energy supply) and the reduced cofactor NADH.

Pyruvate is an important intermediary compound of metabolism. For example, under aerobic conditions pyruvate may be oxidized to acetyl coenzyme A (acetyl-CoA), which then enters the tricarboxylic acid cycle (TCA), which in turn generates synthetic precursors, $CO_2$, and reduced cofactors. The cofactors are then oxidized by donating hydrogen equivalents, via a series of enzymatic steps, to oxygen resulting in the formation of water and ATP. This process of energy formation is known as oxidative phosphorylation.

Under anaerobic conditions (no available oxygen), fermentation occurs in which the degradation products of organic compounds serve as hydrogen donors and acceptors. Excess NADH from glycolysis is oxidized in reactions involving the reduction of organic substrates to products, such as lactate and ethanol. In addition, ATP is regenerated from the production of organic acids, such as acetate, in a process known as substrate level phosphorylation. Therefore, the fermentation products of glycolysis and pyruvate metabolism include a variety of organic acids, alcohols and $CO_2$.

Most facultative anaerobes metabolize pyruvate aerobically via pyruvate dehydrogenase (PDH) and the tricarboxylic acid cycle (TCA). Under anaerobic conditions, the main energy pathway for the metabolism of pyruvate is via pyruvate-formate-lyase (PFL) pathway to give formate and acetyl-CoA. Acetyl-CoA is then converted to acetate, via phosphotransacetylase (PTA) and acetate kinase (ACK) with the co-production of ATP, or reduced to ethanol via acetaldehyde dehydrogenase (ACDH) and alcohol dehydrogenase (ADH). In order to maintain a balance of reducing equivalents, excess NADH produced from glycolysis is re-oxidized to $NAD^+$ by lactate dehydrogenase (LDH) during the reduction of pyruvate to lactate. NADH can also be re-oxidized by ACDH and ADH during the reduction of acetyl-CoA to ethanol, but this is a minor reaction in cells with a functional LDH.

Alternate pathways from acetate to acetyl-CoA can be achieved by the expression of the bacterial system of PTA and ACK. These two enzymes can act sequentially to produce acetyl-CoA from acetate. Due to the difference in co-factors between PTA/ACK and ACS, this pathway could have higher activity in vivo when heterologously expressed. Sources for PTA and ACK can come from a large variety of bacterial sources including but not limited to *Escherichia*, *Thermoanaerobacter*, *Clostridia*, and *Bacillus* species. Examples of expression of PTA and ACK for the production of alcohols and other desired products are disclosed in commonly owned International Publication No. WO 2011/140386, which is incorporated by reference herein in its entirety.

In some embodiments, the PTA is from *Bifidobacterium adolescentis*. *Bifidobacterium adolescentis* PTA nucleotide and amino acid sequences correspond to SEQ ID NO:119 and SEQ ID NO:120, respectively. In some embodiments, the PTA is from *Leuconostoc mesenteroides*. *Leuconostoc mesenteroides* PTA nucleotide and amino acid sequences correspond to SEQ ID NO:121 and SEQ ID NO:122, respectively. In some embodiments, the PTA is from *Oenococcus oenii*. *Oenococcus oenii* PTA nucleotide and amino acid sequences correspond to SEQ ID NO:123 and SEQ ID NO: 124, respectively. In some embodiments, the ACK is from *Bifidobacterium adolescentis*. *Bifidobacterium adolescentis* ACK nucleotide and amino acid sequences correspond to SEQ ID NO: 125 and SEQ ID NO:126, respectively. In some embodiments, ACK is from *Leuconostoc mesenteroides*. *Leuconostoc mesenteroides* ACK nucleotide and amino acid sequences correspond to SEQ ID NO:127 and SEQ ID NO:128, respectively. In some embodiments, the ACK is from *Oenococcus oenii*. *Oenococcus oenii* ACK nucleotide and amino acid sequences correspond to SEQ ID NO:129 and SEQ ID NO:130, respectively.

Host Cells

Host cells useful in the present invention include any prokaryotic or eukaryotic cells; for example, microorganisms selected from bacterial, algal, and yeast cells. Among host cells thus suitable for the present invention are microorganisms, for example, of the genera *Aeromonas*, *Aspergillus*, *Bacillus*, *Escherichia*, *Kluyveromyces*, *Pichia*, *Rhodococcus*, *Saccharomyces* and *Streptomyces*.

In some embodiments, the host cells are microorganisms. In one embodiment the microorganism is a yeast. According to the present invention the yeast host cell can be, for example, from the genera *Saccharomyces*, *Kluyveromyces*, *Candida*, *Pichia*, *Schizosaccharomyces*, *Hansenula*, *Kloeckera*, *Schwanniomyces*, and *Yarrowia*. Yeast species as host cells may include, for example, *S. cerevisiae*, *S. bulderi*, *S. barnetti*, *S. exiguus*, *S. uvarum*, *S. diastaticus*, *K. lactis*, *K. marxianus*, or *K. fragilis*. In some embodiments, the yeast is selected from the group consisting of *Saccharomyces cerevisiae*, *Schizzosaccharomyces pombe*, *Candida albicans*, *Pichia pastoris*, *Pichia stipitis*, *Yarrowia lipolytica*, *Hansenula polymorpha*, *Phaffia rhodozyma*, *Candida utilis*, *Arxula adeninivorans*, *Debaryomyces hansenii*, *Debaryomyces polymorphus*, *Schizosaccharomyces pombe* and *Schwanniomyces occidentalis*. In one particular embodiment, the yeast is *Saccharomyces cerevisiae*. In another embodiment, the yeast is the *S. cerevisiae* strain PE-2. In yet another embodiment, the yeast is a thermotolerant *Saccharomyces cerevisiae*. The selection of an appropriate host is deemed to be within the scope of those skilled in the art from the teachings herein.

In some embodiments, the host cell is an oleaginous cell. The oleaginous host cell can be an oleaginous yeast cell. For example, the oleaginous yeast host cell can be from the genera *Blakeslea*, *Candida*, *Cryptococcus*, *Cunninghamella*, *Lipomyces*, *Mortierella*, *Mucor*, *Phycomyces*, *Pythium*, *Rhodosporidum*, *Rhodotorula*, *Trichosporon* or *Yarrowia*. According to the present invention, the oleaginous host cell can be an oleaginous microalgae host cell. For example, the oleaginous microalgea host cell can be from the genera *Thraustochytrium* or *Schizochytrium*. Biodiesel could then be produced from the triglyceride produced by the oleaginous organisms using conventional lipid transesterification processes. In some particular embodiments, the oleaginous host cells can be induced to secrete synthesized lipids. Embodiments using oleaginous host cells are advantageous because they can produce biodiesel from lignocellulosic feedstocks which, relative to oilseed substrates, are cheaper, can be grown more densely, show lower life cycle carbon dioxide emissions, and can be cultivated on marginal lands.

In some embodiments, the host cell is a thermotolerant host cell. Thermotolerant host cells can be particularly useful in simultaneous saccharification and fermentation processes by allowing externally produced cellulases and ethanol-producing host cells to perform optimally in similar temperature ranges.

Thermotolerant host cells can include, for example, *Issatchenkia orientalis*, *Pichia mississippiensis*, *Pichia mexicana*, *Pichia farinosa*, *Clavispora opuntiae*, *Clavispora lusitaniae*, *Candida mexicana*, *Hansenula polymorpha* and *Kluyveromyces* host cells. In some embodiments, the thermotolerant cell is an *S. cerevisiae* strain, or other yeast strain, that has been adapted to grow in high temperatures, for example, by selection for growth at high temperatures in a cytostat.

In some particular embodiments, the host cell is a *Kluyveromyces* host cell. For example, the *Kluyveromyces* host cell can be a *K. lactis*, *K. marxianus*, *K. blattae*, *K. phaffii*, *K. yarrowii*, *K. aestuarii*, *K. dobzhanskii*, *K. wick-* erhamii *K. thermotolerans*, or *K. waltii* host cell. In one embodiment, the host cell is a *K. lactis*, or *K. marxianus* host cell. In another embodiment, the host cell is a *K. marxianus* host cell.

In some embodiments, the thermotolerant host cell can grow at temperatures above about 30° C., about 31° C., about 32° C., about 33° C., about 34° C., about 35° C., about 36° C., about 37° C., about 38° C., about 39° C., about 40° C., about 41° C. or about 42° C. In some embodiments of the present invention the thermotolerant host cell can produce ethanol from cellulose at temperatures above about 30° C., about 31° C., about 32° C., about 33° C., about 34° C., about 35° C., about 36° C., about 37° C., about 38° C., about 39° C., about 40° C., about 41° C., about 42° C., or about 43° C., or about 44° C., or about 45° C., or about 50° C.

In some embodiments of the present invention, the thermotolerant host cell can grow at temperatures from about 30° C. to 60° C., about 30° C. to 55° C., about 30° C. to 50° C., about 40° C. to 60° C., about 40° C. to 55° C. or about 40° C. to 50° C. In some embodiments of the present invention, the thermotolterant host cell can produce ethanol from cellulose at temperatures from about 30° C. to 60° C., about 30° C. to 55° C., about 30° C. to 50° C., about 40° C. to 60° C., about 40° C. to 55° C. or about 40° C. to 50° C.

In some embodiments, the host cell has the ability to metabolize xylose. Detailed information regarding the development of the xylose-utilizing technology can be found in the following publications: Kuyper M et al. *FEMS Yeast Res.* 4: 655-64 (2004), Kuyper M et al. *FEMS Yeast Res.* 5:399-409 (2005), and Kuyper M et al. *FEMS Yeast Res.* 5:925-34 (2005), which are herein incorporated by reference in their entirety. For example, xylose-utilization can be accomplished in *S. cerevisiae* by heterologously expressing the xylose isomerase gene, XylA, e.g., from the anaerobic fungus *Piromyces* sp. E2, overexpressing five *S. cerevisiae* enzymes involved in the conversion of xylulose to glycolytic intermediates (xylulokinase, ribulose 5-phosphate isomerase, ribulose 5-phosphate epimerase, transketolase and transaldolase) and deleting the GRE3 gene encoding aldose reductase to minimize xylitol production.

In some embodiments, the host cell has the ability to metabolize arabinose. For example, arabinose-utilization can be accomplished by heterologously expressing, e.g., one or more arabinose isomerase, ribulokinase, or ribulose phosphate epimerase. The host cells can contain antibiotic markers or can contain no antibiotic markers.

In certain embodiments, the host cell is a microorganism that is a species of the genera *Thermoanaerobacterium*, *Thermoanaerobacter*, *Clostridium*, *Geobacillus*, *Saccharococcus*, *Paenibacillus*, *Bacillus*, *Caldicellulosiruptor*, *Anaerocellum*, or *Anoxybacillus*. In certain embodiments, the host cell is a bacterium selected from the group consisting of: *Thermoanaerobacterium thermosulfurigenes*, *Thermoanaerobacterium aotearoense*, *Thermoanaerobacterium polysaccharolyticum*, *Thermoanaerobacterium zeae*, *Thermoanaerobacterium xylanolyticum*, *Thermoanaerobacterium saccharolyticum*, *Thermoanaerobium brockii*, *Thermoanaerobacterium thermosaccharolyticum*, *Thermoanaerobacter thermohydrosulfuricus*, *Thermoanaerobacter ethanolicus*, *Thermoanaerobacter brocki*, *Clostridium thermocellum*, *Clostridium cellulolyticum*, *Clostridium phytofermentans*, *Clostridium straminosolvens*, *Geobacillus thermoglucosidasius*, *Geobacillus stearothermophilus*, *Saccharococcus caldoxylosilyticus*, *Saccharoccus thermophilus*, *Paenibacillus campinasensis*, *Bacillus flavothermus*, *Anoxybacillus kamchatkensis*, *Anoxybacillus gonensis*, *Caldicellulosiruptor acetigenus*, *Caldicellulosiruptor saccharolyticus*, *Caldicellulosiruptor kristjanssonii*, *Caldicellulosiruptor owensensis*, *Caldicellulosiruptor lactoaceticus*, and *Anaerocellum thermophilum*. In certain embodiments, the host cell is *Clostridium thermocellum*, *Clostridium cellulolyticum*, or *Thermoanaerobacterium saccharolyticum*.

Codon Optimized Polynucleotides

The polynucleotides encoding heterologous cellulases can be codon-optimized. As used herein the term "codon-optimized coding region" means a nucleic acid coding region that has been adapted for expression in the cells of a given organism by replacing at least one, or more than one, or a significant number, of codons with one or more codons that are more frequently used in the genes of that organism.

In general, highly expressed genes in an organism are biased towards codons that are recognized by the most abundant tRNA species in that organism. One measure of this bias is the "codon adaptation index" or "CAI," which measures the extent to which the codons used to encode each amino acid in a particular gene are those which occur most frequently in a reference set of highly expressed genes from an organism.

The CAI of codon optimized sequences of the present invention corresponds to between about 0.8 and 1.0, between about 0.8 and 0.9, or about 1.0. A codon optimized sequence may be further modified for expression in a particular organism, depending on that organism's biological constraints. For example, large runs of "As" or "Ts" (e.g., runs greater than 3, 4, 5, 6, 7, 8, 9, or 10 consecutive bases) can be removed from the sequences if these are known to effect transcription negatively. Furthermore, specific restriction enzyme sites may be removed for molecular cloning purposes. Examples of such restriction enzyme sites include PacI, AscI, BamHI, BglII, EcoRI and XhoI. Additionally, the DNA sequence can be checked for direct repeats, inverted repeats and mirror repeats with lengths of ten bases or longer, which can be modified manually by replacing codons with "second best" codons, i.e., codons that occur at the second highest frequency within the particular organism for which the sequence is being optimized.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 4. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 4

The Standard Genetic Code

| T | T | | C | | A | | G | |
|---|---|---|---|---|---|---|---|---|
| | TTT Phe (F) | TCT Ser (S) | | TAT Tyr (Y) | | TGT Cys (C) | |
| | TTC " | | TCC " | | TAC " | | TGC " | |
| | TTA Leu (L) | | TCA " | | TAA Ter | | TGA Ter | |
| | TTG " | | TCG " | | TAG Ter | | TGG Trp (W) | |

TABLE 4-continued

The Standard Genetic Code

|   | T |   |   | C |   |   | A |   |   | G |   |   |
|---|---|---|---|---|---|---|---|---|---|---|---|---|
| C | CTT | Leu | (L) | CCT | Pro | (P) | CAT | His | (H) | CGT | Arg | (R) |
|   | CTC | "   |     | CCC | "   |     | CAC | "   |     | CGC | "   |     |
|   | CTA | "   |     | CCA | "   |     | CAA | Gln | (Q) | CGA | "   |     |
|   | CTG | "   |     | CCG | "   |     | CAG | "   |     | CGG | "   |     |
| A | ATT | Ile | (I) | ACT | Thr | (T) | AAT | Asn | (N) | AGT | Ser | (S) |
|   | ATC | "   |     | ACC | "   |     | AAC | "   |     | AGC | "   |     |
|   | ATA | "   |     | ACA | "   |     | AAA | Lys | (K) | AGA | Arg | (R) |
|   | ATG | Met | (M) | ACG | "   |     | AAG | "   |     | AGG | "   |     |
| G | GTT | Val | (V) | GCT | Ala | (A) | CAT | Asp | (D) | GGT | Gly | (G) |
|   | GTC | "   |     | GCC | "   |     | GAC | "   |     | GGC | "   |     |
|   | GTA | "   |     | GCA | "   |     | GAA | Glu | (E) | GGA | "   |     |
|   | GTG | "   |     | GCG | "   |     | GAG | "   |     | GGG | "   |     |

Many organisms display a bias for use of particular codons to code for insertion of a particular amino acid in a growing peptide chain. Codon preference or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available, for example, at www.kazusa.or.jp/codon/ (visited Jun. 20, 2013), and these tables can be adapted in a number of ways. See Nakamura, Y., et al. "Codon usage tabulated from the international DNA sequence databases: status for the year 2000," *Nucl. Acids Res.* 28:292 (2000). Codon usage tables for yeast, calculated from GenBank Release 128.0 [15 Feb. 2002], are reproduced below as Table 52. This table uses mRNA nomenclature, and so instead of thymine (T) which is found in DNA, the tables use uracil (U) which is found in RNA. The table has been adapted so that frequencies are calculated for each amino acid, rather than for all 64 codons.

TABLE 5

Codon Usage Table for *Saccharomyces cerevisiae* Genes

| Amino Acid | Codon | Number | Frequency per hundred |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |

TABLE 5-continued

Codon Usage Table for *Saccharomyces cerevisiae* Genes

| Amino Acid | Codon | Number | Frequency per hundred |
|---|---|---|---|
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species. Codon-optimized coding regions can be designed by various different methods.

In one method, a codon usage table is used to find the single most frequent codon used for any given amino acid, and that codon is used each time that particular amino acid appears in the polypeptide sequence. For example, referring to Table 4 above, for leucine, the most frequent codon is UUG, which is used 27.2% of the time. Thus all the leucine residues in a given amino acid sequence would be assigned the codon UUG.

In another method, the actual frequencies of the codons are distributed randomly throughout the coding sequence. Thus, using this method for optimization, if a hypothetical polypeptide sequence had 100 leucine residues, referring to Table 4 for frequency of usage in the *S. cerevisiae*, about 5, or 5% of the leucine codons would be CUC, about 11, or 11% of the leucine codons would be CUG, about 12, or 12% of the leucine codons would be CUU, about 13, or 13% of the leucine codons would be CUA, about 26, or 26% of the leucine codons would be UUA, and about 27, or 27% of the leucine codons would be UUG.

These frequencies would be distributed randomly throughout the leucine codons in the coding region encoding the hypothetical polypeptide. As will be understood by those of ordinary skill in the art, the distribution of codons in the sequence can vary significantly using this method; however, the sequence always encodes the same polypeptide.

When using the methods above, the term "about" is used precisely to account for fractional percentages of codon frequencies for a given amino acid. As used herein, "about" is defined as one amino acid more or one amino acid less than the value given. The whole number value of amino acids is rounded up if the fractional frequency of usage is 0.50 or greater, and is rounded down if the fractional frequency of use is 0.49 or less. Using again the example of the frequency of usage of leucine in human genes for a hypothetical polypeptide having 62 leucine residues, the fractional frequency of codon usage would be calculated by multiplying 62 by the frequencies for the various codons. Thus, 7.28 percent of 62 equals 4.51 UUA codons, or "about 5," i.e., 4, 5, or 6 UUA codons, 12.66 percent of 62 equals 7.85 UUG codons or "about 8," i.e., 7, 8, or 9 UUG codons, 12.87 percent of 62 equals 7.98 CUU codons, or "about 8," i.e., 7, 8, or 9 CUU codons, 19.56 percent of 62 equals 12.13 CUC codons or "about 12," i.e., 11, 12, or 13 CUC codons, 7.00 percent of 62 equals 4.34 CUA codons or "about 4," i.e., 3, 4, or 5 CUA codons, and 40.62 percent of 62 equals 25.19 CUG codons, or "about 25," i.e., 24, 25, or 26 CUG codons.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNTI Suite, available from InforMax, Inc., Bethesda, Md., and the "backtranslate" function in the GCG—Wisconsin Package, available from Accelrys, Inc., San Diego, Calif. In addition, various resources are publicly available to codon-optimize coding region sequences, e.g., the "backtranslation" function at www.entelechon.com/2008/10/backtranslation-tool/ (visited Jun. 20, 2013) and the "backtranseq" function Jun. 20, 2013). Constructing a rudimentary algorithm to assign codons based on a given frequency can also easily be accomplished with basic mathematical functions by one of ordinary skill in the art.

A number of options are available for synthesizing codon optimized coding regions designed by any of the methods described above, using standard and routine molecular biological manipulations well known to those of ordinary skill in the art. In one approach, a series of complementary oligonucleotide pairs of 80-90 nucleotides each in length and spanning the length of the desired sequence is synthesized by standard methods. These oligonucleotide pairs are synthesized such that upon annealing, they form double stranded fragments of 80-90 base pairs, containing cohesive ends, e.g., each oligonucleotide in the pair is synthesized to extend 3, 4, 5, 6, 7, 8, 9, 10, or more bases beyond the region that is complementary to the other oligonucleotide in the pair. The single-stranded ends of each pair of oligonucleotides is designed to anneal with the single-stranded end of another pair of oligonucleotides. The oligonucleotide pairs are allowed to anneal, and approximately five to six of these double-stranded fragments are then allowed to anneal together via the cohesive single stranded ends, and then they ligated together and cloned into a standard bacterial cloning vector, for example, a TOPO® vector available from Invitrogen Corporation, Carlsbad, Calif. The construct is then sequenced by standard methods. Several of these constructs consisting of 5 to 6 fragments of 80 to 90 base pair fragments ligated together, i.e., fragments of about 500 base pairs, are prepared, such that the entire desired sequence is represented in a series of plasmid constructs. The inserts of these plasmids are then cut with appropriate restriction enzymes and ligated together to form the final construct. The final construct is then cloned into a standard bacterial cloning vector, and sequenced. Additional methods would be immediately apparent to the skilled artisan. In addition, gene synthesis is readily available commercially.

In additional embodiments, a full-length polypeptide sequence is codon-optimized for a given species resulting in a codon-optimized coding region encoding the entire polypeptide, and then nucleic acid fragments of the codon-optimized coding region, which encode fragments, variants, and derivatives of the polypeptide are made from the original codon-optimized coding region. As would be well understood by those of ordinary skill in the art, if codons have been randomly assigned to the full-length coding region based on their frequency of use in a given species, nucleic acid fragments encoding fragments, variants, and derivatives would not necessarily be fully codon optimized for the given species. However, such sequences are still much closer to the codon usage of the desired species than the native codon usage. The advantage of this approach is that synthesizing codon-optimized nucleic acid fragments encoding each fragment, variant, and derivative of a given polypeptide, although routine, would be time consuming and would result in significant expense.

Transposons

To select for foreign DNA that has entered a host it is preferable that the DNA be stably maintained in the organism of interest. With regard to plasmids, there are two processes by which this can occur. One is through the use of replicative plasmids. These plasmids have origins of replication that are recognized by the host and allow the plasmids to replicate as stable, autonomous, extrachromosomal elements that are partitioned during cell division into daughter cells. The second process occurs through the integration of a plasmid onto the chromosome. This predominately happens by homologous recombination and results in the insertion of the entire plasmid, or parts of the plasmid, into the host chromosome. Thus, the plasmid and selectable marker(s) are replicated as an integral piece of the chromosome and segregated into daughter cells. Therefore, to ascertain if plasmid DNA is entering a cell during a transformation event through the use of selectable markers requires the use of a replicative plasmid or the ability to recombine the plasmid onto the chromosome. These qualifiers cannot always be met, especially when handling organisms that do not have a suite of genetic tools.

One way to avoid issues regarding plasmid-associated markers is through the use of transposons. A transposon is a mobile DNA element, defined by mosaic DNA sequences that are recognized by enzymatic machinery referred to as a transposase. The function of the transposase is to randomly insert the transposon DNA into host or target DNA. A selectable marker can be cloned onto a transposon by standard genetic engineering. The resulting DNA fragment can be coupled to the transposase machinery in an in vitro reaction and the complex can be introduced into target cells by electroporation. Stable insertion of the marker onto the chromosome requires only the function of the transposase machinery and alleviates the need for homologous recombination or replicative plasmids.

The random nature associated with the integration of transposons has the added advantage of acting as a form of mutagenesis. Libraries can be created that comprise amalgamations of transposon mutants. These libraries can be used in screens or selections to produce mutants with desired phenotypes. For instance, a transposon library of a CBP organism could be screened for the ability to produce more ethanol, or less lactic acid and/or more acetate.

Native Cellulolytic Strategy

Naturally occurring cellulolytic microorganisms are starting points for CBP organism development via the native strategy. Anaerobes and facultative anaerobes are of particular interest. The primary objective is to engineer the metabolization of biomass to solvents, including but not limited to, acetone, isopropanol, ethyl acetate, or ethanol. Metabolic engineering of mixed-acid fermentations in relation to, for example, ethanol production, has been successful in the case of mesophilic, non-cellulolytic, enteric bacteria. Recent developments in suitable gene-transfer techniques allow for this type of work to be undertaken with cellulolytic bacteria.

Recombinant Cellulolytic Strategy

Non-cellulolytic microorganisms with desired product-formation properties are starting points for CBP organism development by the recombinant cellulolytic strategy. The primary objective of such developments is to engineer a heterologous cellulase system that enables growth and fermentation on pretreated lignocellulose. The heterologous production of cellulases has been pursued primarily with bacterial hosts producing ethanol at high yield (engineered strains of E. coli, Klebsiella oxytoca, and Zymomonas mobilis) and the yeast Saccharomyces cerevisiae. Cellulase expression in strains of K. oxytoca resulted in increased hydrolysis yields—but not growth without added cellulase—for microcrystalline cellulose, and anaerobic growth on amorphous cellulose. Although dozens of saccharolytic enzymes have been functionally expressed in S. cerevisiae, anaerobic growth on cellulose as the result of such expression has not been definitively demonstrated.

Aspects of the present invention relate to the use of thermophilic or mesophilic microorganisms as hosts for modification via the native cellulolytic strategy. Their potential in process applications in biotechnology stems from their ability to grow at relatively high temperatures with attendant high metabolic rates, production of physically and chemically stable enzymes, and elevated yields of end products. Major groups of thermophilic bacteria include eubacteria and archaebacteria. Thermophilic eubacteria include: phototropic bacteria, such as cyanobacteria, purple bacteria, and green bacteria; Gram-positive bacteria, such as Bacillus, Clostridium, Lactic acid bacteria, and Actinomyces; and other eubacteria, such as Thiobacillus, Spirochete, Desulfotomaculum, Gram-negative aerobes, Gram-negative anaerobes, and Thermotoga. Within archaebacteria are considered Methanogens, extreme thermophiles (an art-recognized term), and Thermoplasma. In certain embodiments, the present invention relates to Gram-negative organotrophic thermophiles of the genera Thermus, Gram-positive eubacteria, such as genera Clostridium, and also which comprise both rods and cocci, genera in group of eubacteria, such as Thermosipho and Thermotoga, genera of Archaebacteria, such as Thermococcus, Thermoproteus (rod-shaped), Thermofilum (rod-shaped), Pyrodictium, Acidianus, Sulfolobus, Pyrobaculum, Pyrococcus, Thermodiscus, Staphylothermus, Desulfurococcus, Archaeoglobus, and Methanopyrus. Some examples of thermophilic or mesophilic (including bacteria, prokaryotic microorganism, and fungi), which may be suitable for the present invention include, but are not limited to: Clostridium thermosulfurogenes, Clostridium cellulolyticum, Clostridium thermocellum, Clostridium thermohydrosulfuricum, Clostridium thermoaceticum, Clostridium thermosaccharolyticum, Clostridium tartarivorum, Clostridium thermocellulaseum, Clostridium phytofermentans, Clostridium straminosolvens, Thermoanaerobacterium thermosaccarolyticum, Thermoanaerobacterium saccharolyticum, Thermobacteroides acetoethylicus, Thermoanaerobium brockii, Methanobacterium thermoautotrophicum, Anaerocellum thermophilium, Pyrodictium occultum, Thermoproteus neutrophilus, Thermofilum librum, Thermothrix thioparus, Desulfovibrio thermophilus, Thermoplasma acidophilum, Hydrogenomonas thermophilus, Thermomicrobium roseum, Thermus flavas, Thermus ruber, Pyrococcus furiosus, Thermus aquaticus, Thermus thermophilus, Chloroflexus auruntiacus, Thermococcus litoralis, Pyrodictium abyssi, Bacillus stearothermophilus, Cyanidium caldarium, Mastigocladus laminosus, Chlamydothrix calidissima, Chlamydothrix penicillata, Thiothrix carnea, Phormidium tenuissimum, Phormidium geysericola, Phormidium subterraneum, Phormidium bijahensi, Oscillatoria filiformis, Synechococcus lividus, Chloroflexus aurantiacus, Pyrodictium brockii, Thiobacillus thiooxidans, Sulfolobus acidocaldarius, Thiobacillus thermophilica, Bacillus stearothermophilus, Cercosulcifer hamathensis, Vahlkampfla reichi, Cyclidium citrullus, Dactylaria gallopava, Synechococcus lividus, Synechococcus elongatus, Synechococcus minervae, Synechocystis aquatilus, Aphanocapsa thermalis, Oscillatoria terebriformis, Oscillatoria amphibia, Oscillatoria germinate, Oscillatoria okenii, Phormidium laminosum, Phormidium parparasiens, Symploca thermalis, Bacillus acidocaldarias, Bacillus coagulans, Bacillus thermocatenalatus, Bacillus licheniformis, Bacillus pamilas, Bacillus macerans, Bacillus circulans, Bacillus laterosporus, Bacillus brevis, Bacillus subtilis, Bacillus sphaericus, Desulfotomaculum nigrificans, Streptococcus thermophilus, Lactobacillus thermophilus, Lactobacillus bulgaricus, Bifidobacterium thermophilum, Streptomyces fragmentosporus, Streptomyces thermonitrificans, Streptomyces thermovulgaris, Pseudonocardia thermophila, Thermoactinomyces vulgaris, Thermoactinomyces sacchari, Thermoactinomyces candidas, Thermomonospora curvata, Thermomonospora viridis, Thermomonospora citrina, Microbispora thermodiastatica, Microbispora aerata, Microbispora bispora, Actinobifida dichotomica, Actinobifida chromogens, Micropolyspora caesia, Micropolyspora faeni, Micropolyspora cectivugida, Micropolyspora cabrobrunea, Micropolyspora thermovirida, Micropolyspora viridinigra, Methanobacterium thermoautothropicum, Caldicellulosiruptor acetigenus, Caldicellulosiruptor saccharolyticus, Caldicellulosiruptor kristjanssonii, Caldicellulosiruptor owensensis, Caldicellulosiruptor lactoaceticus, variants thereof, and/or progeny thereof.

In particular embodiments, the present invention relates to thermophilic bacteria selected from the group consisting of Clostridium cellulolyticum, Clostridium thermocellum, and Thermoanaerobacterium saccharolyticum.

In certain embodiments, the present invention relates to thermophilic bacteria selected from the group consisting of

*Fervidobacterium gondwanense, Clostridium thermolacticum, Moorella* sp., and *Rhodothermus marinus*.

In certain embodiments, the present invention relates to thermophilic bacteria of the genera *Thermoanaerobacterium* or *Thermoanaerobacter*, including, but not limited to, species selected from the group consisting of: *Thermoanaerobacterium thermosulfurigenes, Thermoanaerobacterium aotearoense, Thermoanaerobacterium polysaccharolyticum, Thermoanaerobacterium zeae, Thermoanaerobacterium xylanolyticum, Thermoanaerobacterium saccharolyticum, Thermoanaerobium brockii, Thermoanaerobacterium thermosaccharolyticum, Thermoanaerobacter thermohydrosulfuricus, Thermoanaerobacter ethanolicus, Thermoanaerobacter brockii*, variants thereof, and progeny thereof.

In certain embodiments, the present invention relates to microorganisms of the genera *Geobacillus, Saccharococcus, Paenibacillus, Bacillus*, and *Anoxybacillus*, including, but not limited to, species selected from the group consisting of: *Geobacillus thermoglucosidasius, Geobacillus stearothermophilus, Saccharococcus caldoxylosilyticus, Saccharoccus thermophilus, Paenibacillus campinasensis, Bacillus flavothermus, Anoxybacillus kamchatkensis, Anoxybacillus gonensis*, variants thereof, and progeny thereof.

In certain embodiments, the present invention relates to mesophilic bacteria selected from the group consisting of *Saccharophagus degradans; Flavobacterium johnsoniae; Fibrobacter succinogenes; Clostridium hungatei; Clostridium phytofermentans; Clostridium cellulolyticum; Clostridium aldrichii; Clostridium termitididis; Acetivibrio cellulolyticus; Acetivibrio ethanolgignens; Acetivibrio multivorans; Bacteroides cellulosolvens*; and *Alkalibacter saccharofomentans*, variants thereof and progeny thereof.

Organism Development Via the Native Cellulolytic Strategy

One approach to organism development for CBP begins with organisms that naturally utilize cellulose, hemicellulose and/or other biomass components, which are then genetically engineered to enhance product yield and tolerance. For example, *Clostridium thermocellum* is a thermophilic bacterium that has among the highest rates of cellulose utilization reported. Other organisms of interest are xylose-utilizing thermophiles such as *Thermoanaerobacterium saccharolyticum* and *Thermoanaerobacterium thermosaccharolyticum*. Organic acid production may be responsible for the low concentrations of produced ethanol generally associated with these organisms. Thus, one objective is to eliminate production of acetic and lactic acid in these organisms via metabolic engineering. Substantial efforts have been devoted to developing gene transfer systems for the above-described target organisms and multiple *C. thermocellum* isolates from nature have been characterized. See McLaughlin et al. (2002) *Environ. Sci. Technol.* 36:2122. Metabolic engineering of thermophilic, saccharolytic bacteria is an active area of interest, and knockout of lactate dehydrogenase in *T. saccharolyticum* has recently been reported. See Desai et al. (2004) *Appl. Microbiol. Biotechnol.* 65:600. Knockout of acetate kinase and phosphotransacetylase in this organism is also possible.

Organism Development Via the Recombinant Cellulolytic Strategy

An alternative approach to organism development for CBP involves conferring the ability to grow on lignocellulosic materials to microorganisms that naturally have high product yield and tolerance via expression of a heterologous cellulasic system and perhaps other features. For example, *Saccharomyces cerevisiae* has been engineered to express over two dozen different saccharolytic enzymes. See Lynd et al. (2002) *Microbiol. Mol. Biol. Rev.* 66:506.

Whereas cellulosic hydrolysis has been approached in the literature primarily in the context of an enzymatically-oriented intellectual paradigm, the CBP processing strategy requires that cellulosic hydrolysis be viewed in terms of a microbial paradigm. This microbial paradigm naturally leads to an emphasis on different fundamental issues, organisms, cellulasic systems, and applied milestones compared to those of the enzymatic paradigm. In this context, *C. thermocellum* has been a model organism because of its high growth rate on cellulose together with its potential utility for CBP.

In certain embodiments, organisms useful in the present invention may be applicable to the process known as simultaneous saccharification and fermentation (SSF), which is intended to include the use of said microorganisms and/or one or more recombinant hosts (or extracts thereof, including purified or unpurified extracts) for the contemporaneous degradation or depolymerization of a complex sugar (i.e., cellulosic biomass) and bioconversion of that sugar residue into ethanol by fermentation.

Ethanol Production

According to the present invention, a recombinant microorganism can be used to produce ethanol from biomass, which is referred to herein as lignocellulosic material, lignocellulosic substrate, or cellulosic biomass. Methods of producing ethanol can be accomplished, for example, by contacting the biomass with a recombinant microorganism as described herein, and as described in commonly owned U.S. Patent Application Publication No. 2011/0189744 A1, U.S. Patent Application Publication No. 2011/0312054 A1, U.S. Patent Application Publication No. 2012/0003701, International Publication No. WO 2010/060056, International Publication No. WO 2010/075529, International Publication No. WO 2010/056805, International Publication No. WO 2009/138877, and International Publication No. WO 2010/060056, the contents of each are incorporated by reference herein in their entireties.

Numerous cellulosic substrates can be used in accordance with the present invention. Substrates for cellulose activity assays can be divided into two categories, soluble and insoluble, based on their solubility in water. Soluble substrates include cellodextrins or derivatives, carboxymethyl cellulose (CMC), or hydroxyethyl cellulose (HEC). Insoluble substrates include crystalline cellulose, microcrystalline cellulose (Avicel), amorphous cellulose, such as phosphoric acid swollen cellulose (PASC), dyed or fluorescent cellulose, and pretreated lignocellulosic biomass. These substrates are generally highly ordered cellulosic material and thus only sparingly soluble.

It will be appreciated that suitable lignocellulosic material may be any feedstock that contains soluble and/or insoluble cellulose, where the insoluble cellulose may be in a crystalline or non-crystalline form. In various embodiments, the lignocellulosic biomass comprises, for example, wood, corn, corn stover, sawdust, bark, leaves, agricultural and forestry residues, grasses such as switchgrass, ruminant digestion products, municipal wastes, paper mill effluent, newspaper, cardboard or combinations thereof.

In some embodiments, the invention is directed to a method for hydrolyzing a cellulosic substrate, for example a cellulosic substrate as described above, by contacting the cellulosic substrate with a recombinant microorganism of the invention. In some embodiments, the invention is directed to a method for hydrolyzing a cellulosic substrate, for example a cellulosic substrate as described above, by contacting the cellulosic substrate with a co-culture comprising yeast cells expressing heterologous cellulases.

In some embodiments, the invention is directed to a method for fermenting cellulose. Such methods can be accomplished, for example, by culturing a host cell or co-culture in a medium that contains insoluble cellulose to allow saccharification and fermentation of the cellulose.

The production of ethanol can, according to the present invention, be performed at temperatures of at least about 30° C., about 31° C., about 32° C., about 33° C., about 34° C., about 35° C., about 36° C., about 37° C., about 38° C., about 39° C., about 40° C., about 41° C., about 42° C., about 43° C., about 44° C., about 45° C., about 46° C., about 47° C., about 48° C., about 49° C., or about 50° C. In some embodiments of the present invention the thermotolerant host cell can produce ethanol from cellulose at temperatures above about 30° C., about 31° C., about 32° C., about 33° C., about 34° C., about 35° C., about 36° C., about 37° C., about 38° C., about 39° C., about 40° C., about 41° C., about 42° C., or about 43° C., or about 44° C., or about 45° C., or about 50° C. In some embodiments of the present invention, the thermotolterant host cell can produce ethanol from cellulose at temperatures from about 30° C. to 60° C., about 30° C. to 55° C., about 30° C. to 50° C., about 40° C. to 60° C., about 40° C. to 55° C. or about 40° C. to 50° C.

The production of ethanol (or other products and co-products) can, according to the present invention, further be performed according to the "Brazil process." Under the "Brazil process," non-sterilized cane juice and/or molasses is fermented at a high inoculum to achieve fast fermentations. During the fermentation process, the yeast is repeatedly recycled over the 200+ day crop season by centrifuging the cells and washing them in sulphuric acid to decrease contamination and break up flocculation of cells. Industrial strains isolated from cane ethanol fermentations in Brazil have been shown to have characteristics that allow them to survive the acid washing and fermentation conditions better than typical lab yeast or other industrial yeast isolates. One commonly used S. cerevisiae strain in Brazil, PE-2, is a wild isolate from cane ethanol fermentation. The PE-2 strain has been described by Argueso et al., 2009, which is incorporated by reference herein in its entirety. Argueso et al., "Genome structure of a Saccharomyces cerevisiae strain widely used in bioethanol production," Genome Res. 19(12): 2258-70 (2009); see also JAY291 genome, Saccharomyces Genome Database (SGD), yeastgenome.org/. In the Brazil cane ethanol fermentations, PE-2 and other industrial strains produce an average of 4.5 g/L glycerol. In some embodiments, the PE-2 strain, or a modified version thereof, is used as the host organism. In certain embodiments, ethanol is produced through the fermentation of a host cell according to the Brazil process. In some embodiments, the recombinant microorganism is used to ferment a carbohydrate source wherein the microorganisms are reused after one or more fermentations, and wherein the microorganisms are washed with an acid following each fermentation. In some embodiments, the acid has a pH of between 2.0 and 2.2. In certain embodiments, the acid is sulphuric acid.

In some embodiments, methods of producing ethanol can comprise contacting a cellulosic substrate with a recombinant microorganism or co-culture of the invention and additionally contacting the cellulosic substrate with externally produced cellulase enzymes. Exemplary externally produced cellulase enzymes are commercially available and are known to those of skill in the art.

In some embodiments, the methods comprise producing ethanol at a particular rate. For example, in some embodiments, ethanol is produced at a rate of at least about 0.1 mg per hour per liter, at least about 0.25 mg per hour per liter, at least about 0.5 mg per hour per liter, at least about 0.75 mg per hour per liter, at least about 1.0 mg per hour per liter, at least about 2.0 mg per hour per liter, at least about 5.0 mg per hour per liter, at least about 10 mg per hour per liter, at least about 15 mg per hour per liter, at least about 20.0 mg per hour per liter, at least about 25 mg per hour per liter, at least about 30 mg per hour per liter, at least about 50 mg per hour per liter, at least about 100 mg per hour per liter, at least about 200 mg per hour per liter, at least about 300 mg per hour per liter, at least about 400 mg per hour per liter, at least about 500 mg per hour per liter, at least about 600 mg per hour per liter, at least about 700 mg per hour per liter, at least about 800 mg per hour per liter, at least about 900 mg per hour per liter, at least about 1 g per hour per liter, at least about 1.5 g per hour per liter, at least about 2 g per hour per liter, at least about 2.5 g per hour per liter, at least about 3 g per hour per liter, at least about 3.5 g per hour per liter, at least about 4 g per hour per liter, at least about 4.5 g per hour per liter, or at least about 5 g per hour per liter.

In some embodiments, the host cells of the present invention can produce ethanol at a rate of at least about 0.1 mg per hour per liter, at least about 0.25 mg per hour per liter, at least about 0.5 mg per hour per liter, at least about 0.75 mg per hour per liter, at least about 1.0 mg per hour per liter, at least about 2.0 mg per hour per liter, at least about 5.0 mg per hour per liter, at least about 10 mg per hour per liter, at least about 15 mg per hour per liter, at least about 20.0 mg per hour per liter, at least about 25 mg per hour per liter, at least about 30 mg per hour per liter, at least about 50 mg per hour per liter, at least about 100 mg per hour per liter, at least about 200 mg per hour per liter, at least about 300 mg per hour per liter, at least about 400 mg per hour per liter, at least about 500 mg per hour per liter, at least about 600 mg per hour per liter, at least about 700 mg per hour per liter, at least about 800 mg per hour per liter, at least about 900 mg per hour per liter, at least about 1 g per hour per liter, at least about 1.5 g per hour per liter, at least about 2 g per hour per liter, at least about 2.5 g per hour per liter, at least about 3 g per hour per liter, at least about 3.5 g per hour per liter, at least about 4 g per hour per liter, at least about 4.5 g per hour per liter, or at least about 5 g per hour per liter more than a control strain (e.g., a wild-type strain) and grown under the same conditions. In some embodiments, the ethanol can be produced in the absence of any externally added cellulases.

Ethanol production can be measured using any method known in the art. For example, the quantity of ethanol in fermentation samples can be assessed using HPLC analysis. Many ethanol assay kits are commercially available that use, for example, alcohol oxidase enzyme based assays. Methods of determining ethanol production are within the scope of those skilled in the art from the teachings herein. The U.S. Department of Energy (DOE) provides a method for calculating theoretical ethanol yield. Accordingly, if the weight percentages are known of C6 sugars (i.e., glucan, galactan, mannan), the theoretical yield of ethanol in gallons per dry ton of total C6 polymers can be determined by applying a conversion factor as follows:

(1.11 pounds of C6 sugar/pound of polymeric sugar)×(0.51 pounds of ethanol/pound of sugar)×(2000 pounds of ethanol/ton of C6 polymeric sugar)×(1 gallon of ethanol/6.55 pounds of ethanol)×($\frac{1}{100}$%), wherein the factor (1 gallon of ethanol/6.55 pounds of ethanol) is taken as the specific gravity of ethanol at 20° C.

And if the weight percentages are known of C5 sugars (i.e., xylan, arabinan), the theoretical yield of ethanol in gallons per dry ton of total C5 polymers can be determined by applying a conversion factor as follows:

(1.136 pounds of C5 sugar/pound of C5 polymeric sugar)× (0.51 pounds of ethanol/pound of sugar)×(2000 pounds of ethanol/ton of C5 polymeric sugar)×(1 gallon of ethanol/ 6.55 pounds of ethanol)×(1/100%), wherein the factor (1 gallon of ethanol/6.55 pounds of ethanol) is taken as the specific gravity of ethanol at 20° C.

It follows that by adding the theoretical yield of ethanol in gallons per dry ton of the total C6 polymers to the theoretical yield of ethanol in gallons per dry ton of the total C5 polymers gives the total theoretical yield of ethanol in gallons per dry ton of feedstock.

Applying this analysis, the DOE provides the following examples of theoretical yield of ethanol in gallons per dry ton of feedstock: corn grain, 124.4; corn stover, 113.0; rice straw, 109.9; cotton gin trash, 56.8; forest thinnings, 81.5; hardwood sawdust, 100.8; bagasse, 111.5; and mixed paper, 116.2. It is important to note that these are theoretical yields. The DOE warns that depending on the nature of the feedstock and the process employed, actual yield could be anywhere from 60% to 90% of theoretical, and further states that "achieving high yield may be costly, however, so lower yield processes may often be more cost effective."

EXEMPLIFICATION

The invention now being generally described, it will be more readily understood by reference to the following examples, which are included merely for purposes of illustration of certain aspects and embodiments of the present invention, and are not intended to limit the invention.

Example 1

STL1 Overexpression in Wild Type Strain

Figure 2:
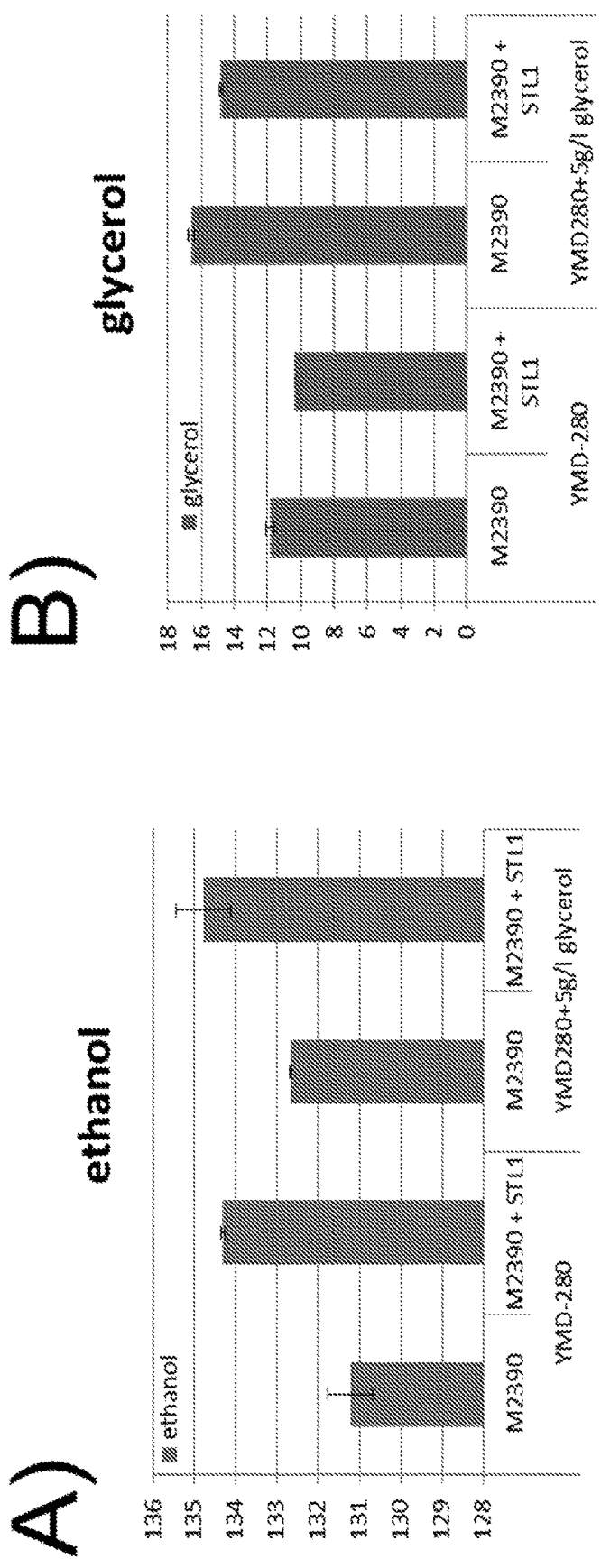
FIGS. 2A and 2B depict glycerol and ethanol concentrations, respectively, in strains of the invention following fermentation in YMD280 medium.

An STL1 expression cassette comprising S. cerevisiae STL1 (FIG. 9 and SEQ ID NOs: 139 and 140) was genetically engineered into M2390 (Ethanol Red (new) from LaSaffre found on-line in the Philbro Performance Products Catalog 23 using the primers listed in Table 6 below. The transformed strain was compared to the non-transformed host strain M2390 during fermentation of laboratory medium YMD-280 (280 maltodextrin, 20 g/L yeast extract, 2 g/L urea, 1 g/L citrate, +/1 5 g/L glycerol) with or without externally supplied glycerol (5 WE, glycerol). YMD-280 medium with or without glycerol was inoculated with M2390 and M2390+STL1 to starting concentration of 0.1 g/L dry cell weight (DCW) and allowed to ferment for 72 hrs. Samples were withdrawn and metabolite concentrations where determined by HPLC. Ethanol concentrations were higher in the strains overexpressing the STL1 gene (FIG. 2A) when compared to the control strain. The increase in ethanol titer was independent of externally supplied glycerol (FIG. 2A). In addition, total glycerol was reduced by approximately 2 g/L in the STL1 expressing strain compared to the control strain, regardless of whether external glycerol was supplied (FIG. 2B).

TABLE 6

Primers to create assembly MA0415.6
(STL1 cassette integrated into the FCY1 locus)
MA0415.6

| Fragment | Primers | Template | Expected Size |
|---|---|---|---|
| FCY 5' Flank | X21754/X24389 | M2390 gDNA | 2018 bp |
| TEF2 pro-STL1-ADH3 ter | X24388/X19513 | pMU3636 | 2709 bp |
| ADH1 pro-STL1-PDC1 ter | X19514/X18955 | pMU3635 | 2950 bp |
| FCY 3' Flank | X19950/X18869 | M2390 gDNA | 2159 bp |

Example 2

STL1 Overexpression in Wild Type Strain

An additional fermentation was performed to determine the effect of STL1 expression in the wild type M2390 background using YMD-2300 medium (300 g/L maltodextrin, 20 g/L yeast extract, 2 g/L urea, 1 g/L citrate, 5 g/L glycerol). M2390 and M5975 (M2390+STL1) were inoculated into 50 mL of YMD-300 to a starting concentration of 0.1 g/L DCW and allowed to ferment for 48 hrs, at which point samples were withdrawn and metabolite concentrations where determined by HPLC. M5975 consumed significantly more sugar and reached a significantly higher titer of ethanol than the M2390 control strain (FIGS. 3A and 3B). Relative to M2390, expression of STL1 in M5975 resulted in extracellular glycerol concentrations that were reduced by 3.3 g/L (FIG. 3C).

Example 3

Overexpression of STL1 in Wild Type Yeast Results in Higher Intracellular Glycerol Concentrations An intracellular assay was used to determine whether expression of STL1 resulted in higher intracellular glycerol concentrations. Strain M5975 overexpresses STL1 due to engineering of STL1 into the FCY1 site on the S. cerevisiae chromosome (the same cassette as described above in Example 1). Both M2390 and M5975 were grown overnight in YPD medium (20 g/L peptone, 10 g/L yeast extract, 20 g/g dextrose), after which cells were harvested and quenched. See Gonzalez, et al., "A Rapid and Reliable Method for Metabolite Extraction in Yeast using Boiling Buffered Ethanol," Yeast 13:1347-56 (1997). Briefly, cells were grown overnight in YPD and the culture was diluted to an $OD_{660}$ of 1.9. Ten milliliters of ice cold methanol were added to 10 mL of the $OD_{660}$ 1.9 culture. The suspension was centrifuged at 5,000 RPMs for 5 min, after which the supernatant was discarded. To each pellet, 5 mL of boiling 75% ethanol/ 250 mM HEPES pH 7.5 was added and allowed to cool on ice for ten minutes. These samples were dehydrated in a speed vac overnight and reconstituted in 500 µL of DI $H_2O$. This suspension was centrifuged and the supernatant was used to assay for glycerol concentration using the Free Glycerol Reagent (Sigma catalog #F6428).

The data of FIG. 4 demonstrates that M5975 has increased intracellular glycerol concentration compared to the parental control, M2390.

Example 4

STL1 Overexpression in Wild Type Strain Reaches a Higher Titer on Corn Mash

Several strains were constructed that contained modifications of STL1 overexpression levels in M2390 and fermentation performance was evaluated on 33% solids corn mash. Strains M2390 and M5975 are described above. Strain M6173 was created using the primers listed in Table 47 below and contains the same promoters and terminators used in MA0415.6 Example 1 above; however, the assembly was integrated in the STL1 locus. See FIG. 10.

Both strains containing upregulation of STL1 (M5975 and M6173) made ~2.5 g/L more ethanol than the parental control (M2390) with a concomitant reduction in glycerol production (FIGS. 5A and 5B). These results indicate that glycerol uptake through STL1 overexpression can reduce overall glycerol production without sacrificing performance in industrially relevant conditions, e.g., fermentation on corn mash.

TABLE 7

Primers to create assembly MA0998
(STL1 cassette integrated into the STL1 locus)
STL1::4copies STL1

| Fragment | Primers | Template | Expected Size |
|---|---|---|---|
| 5' Flank | X24000/X24109 | M2390 gDNA | ~2 kb |
| tef2pro | X24108/X19513 | pMU3636 | 2709 bp |
| adh1pro | X19514/X24111 | pMU3635 | 2950 bp |
| 3' Flank | X24110/X24003 | M2390 gDNA | ~2 kb |

Example 5

STL1 Overexpression in S. cerevisiae Strains Engineered to Secrete a Glucoamylase An *S. fibuligera* glucoamylase expression cassette was engineered into *S. cerevisiae* strain M2390 (described in U.S. patent application Ser. No. 13/696,207 and U.S. patent application Ser. No. 13/701,652, both of which are incorporated by reference herein in their entireties) to create strain M4080. The *S. fibuligera* glucoamylase nucleotide and amino acid sequences correspond to SEQ ID NO:131 and SEQ ID NO:132, respectively. M4080 was subsequently engineered with the STL1 expression cassette of Example 1 above to create strain M6308. Strains M2390, M4080, and M6308 were each inoculated into 50 ml, of 33% solids industrial corn mash and allowed to ferment for 68 hrs prior to sampling and HPLC-based determination of metabolite concentrations. Glucoamylase (Sprizyme ultra, Novozymes) was added to the control (strain M2390) at 0.6 AGU/gTS and at 0.3 AGU/gTS for both M4080 and M6308. The results shown in FIG. 6A demonstrate that expression of STL1 in M6308 enabled the strain to reach a higher titer of ethanol than the wild type yeast (strain M2390) using 50% less externally added glucoamylase. A 0.9 g/L reduction in glycerol was also observed in strain M6308 compared to the control strain (FIG. 6B).

Example 6

STL1 Overexpression in S. cerevisiae Strains Engineered to Produce Formate as an Alternate Electron Sink Strain M3465 was previously engineered to produce formate as an alternative electron sink and the creation of strain M3465 is described in International Publication No. WO 2012/138942, which is incorporated by reference herein in its entirety. M3465 was subsequently engineered with the STL1 expression cassette of Example 1 above to create strain M6211. Strains M2390 (control strain), M3465, and M6211 were each inoculated into 50 mL of 33% solids industrial corn mash and allowed to ferment for 72 hrs prior to sampling and HPLC-based determination of metabolite concentrations. The results shown in FIG. 7A demonstrate that the expression of STL1 in M6211 enabled the strain to reach a higher titer of ethanol production than the wild type yeast strain M2390 and strain M3465. A 2.3 g/L reduction in glycerol production was also observed when compared to the parent strain, M3465. (FIG. 7B).

Example 7

STL1 Overexpression in S. cerevisiae Strains Engineered to Produce Formate as an Alternate Electron Sink and Secrete a Heterologous Glucoamylase Strain M3465 (described above) was further engineered with the glucoamylase expression cassette of Example 5 above to create strain M4361. Strain M4361 was subsequently engineered with the STL1 expression cassette of Example 4 above to create strain M6307. Strains M2390, M4361, and M6307 were each inoculated into 50 mL of 33% solids industrial corn mash and allowed to ferment for 68 hrs prior to sampling and HPLC-based determination of metabolite concentrations. The results shown in FIG. 8A demonstrate that the expression of STL1 in M6307 enabled the strain to reach a higher titer of ethanol production than the wild type yeast (M2390) and strain M4361, which produces formate as an alternative electron sink and expresses an *S. fibuligera* glucoamylase. A 3.7 g/L reduction in glycerol production relative to M2390 was also observed for strain M6307 (FIG. 8B).

Example 8

Creation of S. cerevisiae PE-2 Strains that Overexpress STL1

As described above, industrial strains isolated from cane ethanol fermentations in Brazil have been shown to have characteristics that allow them to survive acid washing and fermentation conditions better than typical lab yeast or other industrial yeast isolates. The most commonly used *S. cerevisiae* strain currently in Brazil, PE-2, is a wild isolate from cane ethanol fermentation. PE-2 and other industrial used strains, produce an average of 4.5 g/L glycerol in the Brazil process. This glycerol passes through the system unused. The Brazil industrial isolate PE-2 was engineered to overexpress the glycerol transporter STL1. One of the isolated Brazilian fuel ethanol strains, BG-1, was found to have additional copies of the STL1 gene located on a translocated region from *Saccharomyces paradoxus*. See Della-Bianca, et al., "What do we know about the yeast strains from the Brazilian fuel ethanol industry?," *Appl. Microbiol. Biotechnol.* 97(3):979-91 (2013), which is incorporated by reference herein in its entirety.

The genetic modification techniques utilized to develop STL1 overexpressing strains rely on direct integration of the STL1 cassette onto both chromosomes in the diploid yeast M7101 (see FIG. 15), a colony isolate of PE-2. The directed integration approach creates transgenic strains with integration events that are stable and easy to characterize.

The modified *S. cerevisiae* strains described herein contain four additional copies of the native *S. cerevisiae* gene STL1 (M7772; ScSTL1), or heterologous STL1 genes from *Saccharomyces paradoxus* (M9725; SpSTL1) or *Pichia sorbitophila* (M9208; PsSTL1) engineered into the PE-2 strain background. See Table 8. Information regarding the genes, donors, and sources are summarized in Table 8. Detailed information regarding the genetic description such as gene copy number is provided in Table 9. The genetic constructs are described in Table 10, and Table 11 describes plasmids used as DNA templates and for transformation purposes. A strain tree depicting the final strains, M7772, M9208 and M9725, is provided in FIG. 13.

TABLE 8

STL1 genes used in *S. cerevisiae* PE-2 STL1 overexpression strains.

| Gene | Donor | Source | Strain generated |
|---|---|---|---|
| STL1 | *Saccharomyces cerevisiae* | *S. cerevisiae* M2390 | M7772 |
| STL1 | *Pichia sorbitophila* | Synthesized gene, codon optimized | M9208 |
| STL1 | *Saccharomyces paradoxus* | Synthesized gene, codon optimized | M9725 |

TABLE 9

STL1 assemblies in *S. cerevisiae* PE-2 strain M7101.

| Target Locus | Locus Modification | Cassette ID | Cassette Description |
|---|---|---|---|
| FCY1 | Replaced with expression cassette | MA415.6 | 4 copies of Sc STL1 |
| FCY1 | Replaced with expression cassette | MA1356 | 4 copies of Ps STL1 |
| FCY1 | Replaces with expression cassette | MAP33 | 4 copies of Sp STL1 |

The STL1 genes of MA415.6, MA1356 and MAP33 (Table 9), were amplified from the templates in Table 10 and gel purified prior to transformation into M7101. The recombinant STL1 gene copies in MA415.6, MA1356 and MAP33 are under the control of native *S. cerevisiae* promoters TEF2 and ADH1, as shown in Table 10, which are oriented on opposing DNA strands of the chromosome to minimize the possibility of recombination between the recombinant STL1 genes at a given locus. These PCR-amplified products were engineered with overlapping ends having homology to DNA flanking the 5' and 3' region of the FCY1 locus to promote homologous recombination in vivo at the FCY1 locus of *S. cerevisiae*. A 2-micron plasmid, pMU228, (FIG. 14) with a hygromycin resistance marker (hph) was co-transformed with the PCR products to enable selection against untransformed cells. The pMU228 plasmid contains the hph gene which confers resistance to hygromycin. This vector can be used for co-transformation with PCR products during the construction of strains. This vector is capable of replicating in both yeast (2 μm ori) and *E. coli* (PMB1 ori). This vector also contains the bla gene for ampicillin resistance in *E. coli* and the *S. cerevisiae* URA3 gene for selection in ura auxotrophs. Without antibiotic selection in yeast, the plasmid is typically lost in two plate passages. Loss of this co-transformation plasmid is confirmed by screening for hygromycin sensitivity.

The transformed cells were first cultivated overnight in YPDS (20 g/L yeast extract, 10 g g/L peptone, 20 g/L dextrose, and 90 g/L sorbitol)+hygromycin (300 μg/ml) broth and then plated on a medium containing 5-FC to select against [functional?] FCY1 and simultaneously assemble and integrate the STL1 cassettes into the chromosome, knocking out the FCY1 gene. FIG. 15 demonstrates how the STL1 expression cassettes were integrated into the FCY1 loci of strain M7101. The 4 DNA fragments: (p1) FCY1 5' flank, (p2) the STL1 cassette with the TEF2 promoter and ADH3 terminator, (p3) the STL1 cassette with the ADH1 promoter and PDC1 terminator, and (p4) the FCY1 3' flank, were engineered with overlapping ends to promote homologous recombination in vivo. Counter-selection against FCY1 using 5-fluorocytosine (5-FC) selects for integration of the STL1 expression cassette. See Hartzog, P. E., et al., "Cytosine deaminase MX cassettes as positive/negative selectable markers in *S. cerevisiae*," Yeast 22:789-798 (2005). Because removal of both copies of FCY1 is necessary for resistance to 5-FC, the expression cassette was found to be integrated at both chromosomes.

TABLE 10

Gene cassettes for STL1 overexpression at the FCY1 locus.

| Fragment | Primers | Template | Expected Size |
|---|---|---|---|
| MA415.6 (Δfcy1::ScSTL1) | | | |
| FCY 5' Flank | X21754/X19552 | M2390 gDNA | 2018 bp |
| TEF2 pro-STL1-ADH3 ter | X19551/X19513 | pMU3636 | 2709 |
| PDC1 ter-STL1-ADH1 pro | X19514/X18955 | pMU3635 | 2950 |
| FCY 3' Flank | X19950/X18869 | M2390 gDNA | 2159 |
| MA1356 (Δfcy1::PsSTL1) | | | |
| FCY1 5' flank (JAY291) | X26376/X26801 | M7101 | 1558 bp |
| TEF2p-STL1 (*P. sorbitophila*)-ADH3t | X26802/X26792 | pMU3432 | 2812 |
| PDC1t-STL1 (*P. sorbitophila*)-ADH1p | X26793/X23413 | YCL482-3 | 3036 |
| FCY1 3' flank (JAY291) | X26822/X26379 | M7101 | 1268 |
| MAP33 (Δfcy1::SpSTL1) | | | |
| FCY1 5' flank (JAY291) (building) Tef2p-STL1 | X26376/X26377 | M7101 | 1517 bp |
| (*S. paradoxus*)-ADH3t (building) ADH1p-STL1 | X26802/X26792 | M9441 | 2788 |
| (*S. paradoxus*)-PDC1t | X26793/X23413 | M9442 | 3030 |
| FCY1 3' flank (JAY291) | X26378/X26379 | M7101 | 1226 |

TABLE 11

Summary of plasmids used in the construction of strain M7772.

| Plasmid | Description |
|---|---|
| pMU3635 | ADH1 promoter-STL1-PDC1 terminator in yeast 2 micron KanMX plasmid; used as template for STL1 with new promoter/terminator construct |

TABLE 11-continued

Summary of plasmids used in the construction of strain M7772.

| Plasmid | Description |
| --- | --- |
| pMU3636 | TEF2 promoter-STL1-ADH3 terminator in yeast 2 micron KanMX plasmid; used as template for STL1 with new promoter/terminator construct |
| pMU228 | HPH-MX, positive and negative selection at all engineered loci; Used as a co-transformation plasmid |

Genetic confirmation of the cassette integration was achieved through PCR genotyping of the FCY1 locus using chromosomal DNA isolated from individual transformants. To confirm that the MA451.6, MA1356, and MAP33 cassettes were inserted at the FCY1 site of strain M7101, PCR products were amplified from genomic DNA that crossed all junctions of the inserted DNA pieces. These products were run on an agarose gel, which showed that the cassettes had integrated correctly and that the insertions removed the native FCY1 gene. The deletion of FCY1 allows for the easy and unique detection of the engineered strains in the lab or industrial environment due to the resistance of the ΔFCY1 strains to 5-FC as well as their inability to grow on minimal media with cytosine as the sole nitrogen source. FCY1 functions in the pyrimidine salvage pathway for DNA synthesis and is required for utilization of cytosine as a nitrogen source. S. cerevisiae strains that have FCY1 knocked out (fcy1Δ) therefore cannot grow on media where cytosine is the sole nitrogen source.

The strains with the correct genotype were passaged several times in the absence of antibiotic selection to ensure that plasmid pMU228 (FIG. 14; Table 11) was cured from the strain. Loss of pMU228 was confirmed by lack of growth when cells were plated on agar plates containing 300 μg/ml hygromycin. Strains M7772, M9208 and M9725 were confirmed to be hygromycin sensitive.

Example 9

Fermentation of S. cerevisiae PE-2 Strains Overexpressing STL1

Minimal Media Fermentations with PE-2 STL1 Strains

STL1 overexpression strains were initially screened in anaerobic fermentations on minimal media. Strains were propagated aerobically on YPD20 broth (yeast extract 20 g/L, peptone 10 g/L, and 20 g/L dextrose) at 35° C. with shaking at 225 rpm. Cultures of 100 g/L glucose Verduyn media, as described in Verduyn, et al., "Effect of benzoic acid on metabolic fluxes in yeasts: A continuous-culture study on the regulation of respiration and alcoholic fermentation," Yeast 8: 501-17 (1992), which is incorporated by reference herein in its entirety, at pH 4.8 were inoculated with 0.5 g/L cells and incubated with shaking at 225 rpm at 35° C. for 48 hrs, and the concentration of glycerol and ethanol were determined by HPLC. M7772, which comprises S. cerevisiae STL1 (ScSTL1), showed a 15% decrease in glycerol in the media as well as about a 2% increase in ethanol production compared to the wild-type parental strain, M7101 (FIG. 16A). The expression of the heterologous STL1 genes from P. sorbitophila and S. paradoxus showed similar results to the S. cerevisiae STL1 overexpression. The P. sorbitophila STL1 expressing strain, M9208, had a 23% reduction in glycerol and a 4% increase in ethanol titer compared to the wild-type PE-2 strain, M7101 (FIG. 16A). The S. paradoxus STL1 expressing strain, M9725, had a 12% reduction in glycerol and a 4% increase in ethanol titer compared to the wild-type PE-2 strain, M7101 (FIG. 16A).

Acid Treatment-Brazilian Cane Ethanol Fermentations

The wild-type parental strain, M7101 (PE-2 isolate), and the S. cerevisiae STL1 overexpression strain, M7772, were compared for their fermentation performance in a lab-scale batch must fermentation and acid wash test. Strains were propagated overnight aerobically in YPD50 medium (yeast extract 20 g/L, peptone 10 g/L, and 50 g/L dextrose) at 35° C. with shaking at 225 rpm. Strains were then inoculated at 10% w/w into an initial fermentation on a must and incubated for 6 hours at 35° C. Must is a mixture of cane syrup and cane molasses at approximately 160 g/L total reducing sugars (TRS) (70:30 mixture based on TRS). The cells were then isolated by centrifugation, stored overnight at 4° C. and then washed with sulphuric acid at pH2.0-2.2 for 30 minutes at room temperature. A second fermentation on must was carried out on the acid washed cells at 35° C. Fermentations were sampled at 6 hours and ethanol and glycerol levels were determined using HPLC as described above. The engineered yeast overexpressing S. cerevisiae STL1, strain M7772, showed a 4.7% increase in ethanol and a 20% reduction in glycerol compared to the parental strain M7101 (FIG. 16B).

We then further tested the S. cerevisiae STL1 strain (M7772) in a scaled down version of the Brazil process that included feeding of the must and acid recycle to assess how glycerol uptake would affect the cells under more process relevant conditions. The wild-type parental strain, M7101 (PE-2 isolate), and the S. cerevisiae STL1 overexpression strain, M7772, were compared for their fermentation performance in a lab-scale fed-batch must fermentation. The strains were taken from glycerol stocks and plated to YPD30 (yeast extract 20 g/L, peptone 10 g/L, and 30 g/L dextrose) plates for 24 hours at 30° C. The strains were then transferred to 40 mL of liquid YPS40 (yeast extract 20 g/L, peptone 10 g/L, and 40 g/L sucrose) medium with an additional 75 g/L molasses added. This step occurred at 30° C. in a 250 mL shake flasks under 175 RPM of agitation. After 24 hours, an additional 40 mL of YPS40 media was added and the process was continued for an additional 12 hours. The cells were then pelleted in 50 mL conical tubes and stored overnight at 4° C. The cell pellets were then reduced to 5 g and 9 mL of water was then added. The pH was then reduced to between 2.0 and 2.2 using 72% sulfuric acid. The reactors were allowed to sit at room temperature for 40 minutes after which they were placed in an incubator at 32° C. and shaken at 250 RPM. 28 g of must was then added to a final concentration of 160 g/L total reducing sugars ("TRS") over 4.5 hours. The fermentation was allowed to continue incubating with shaking for an additional 3-4 hours for a total fermentation time of 7.5-8.5 hours. The reactors were then centrifuged, the supernatant was decanted off, and the supernatant and cell pellets were stored overnight at 4° C. A sample of supernatant was run on HPLC (H and N column) for compositional analysis. The process was then repeated the next day with the only difference being instead of adding 9 mL of water, 2 mL of the supernatant from the previous run was added as well as 7 mL of water. This process was repeated for a total of 14 fermentations and acid treatments.

Figure 17:
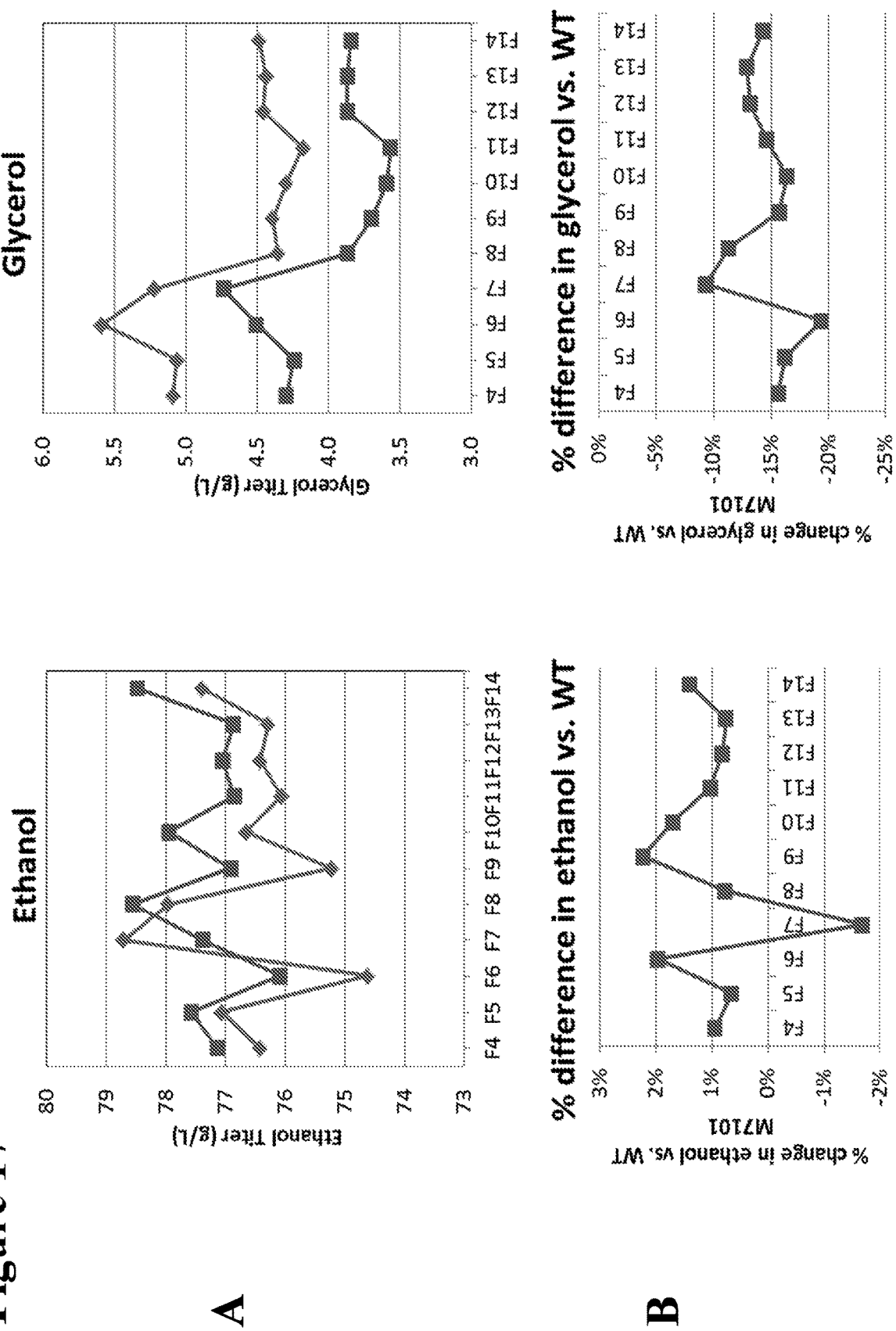
Figure 17:
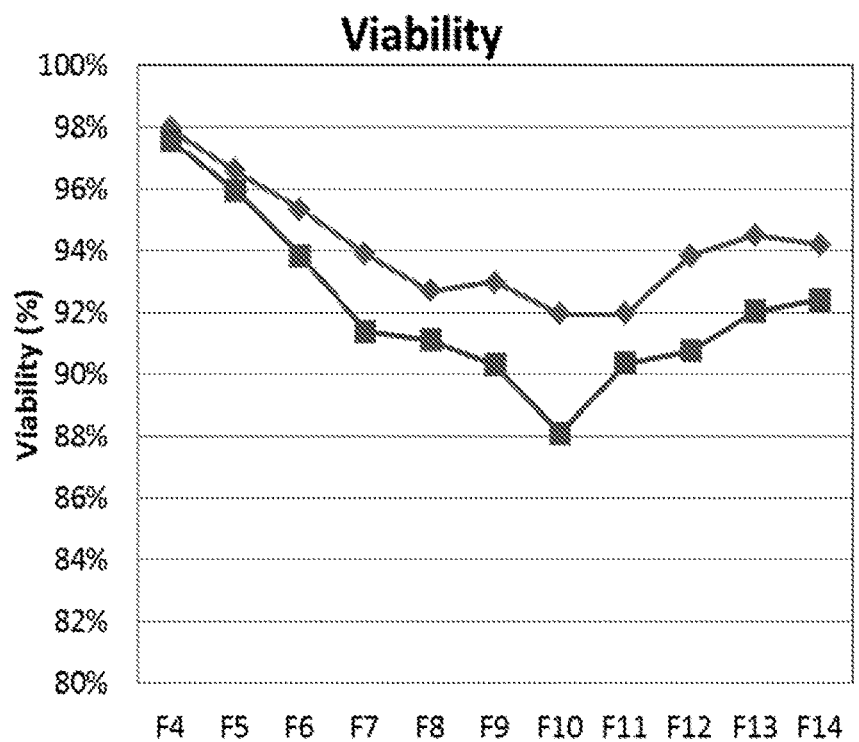
Figure 17:
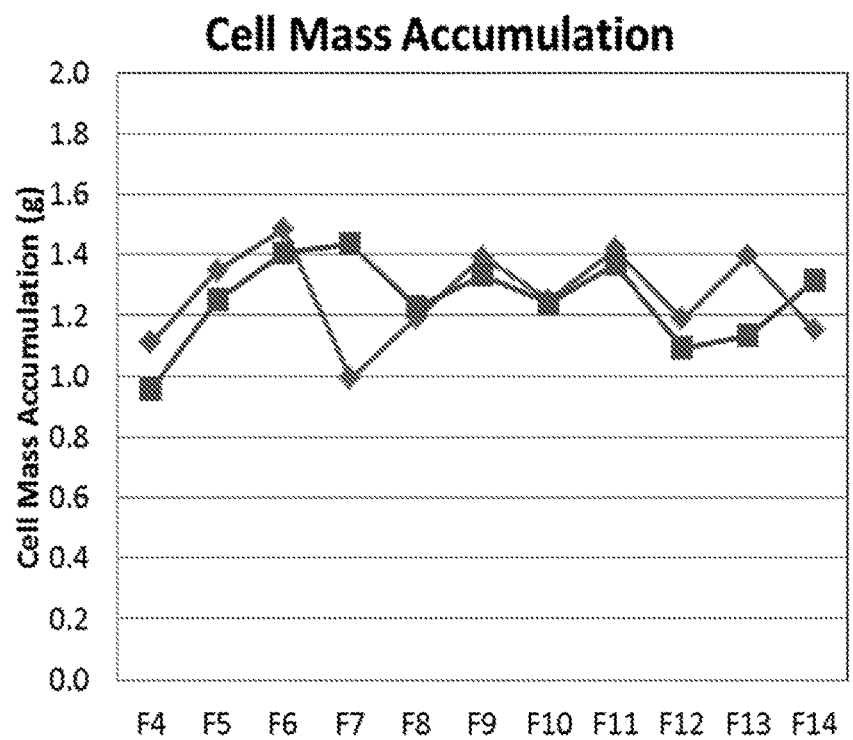

Results for runs 4 through 14 (F4-F14) are shown in FIG. 17. The S. cerevisiae STL1 engineered strain, M7772, shows an average of a 1% increase in ethanol titer over the wild-type M7101 over these 10 fermentations and an average 14% decrease in glycerol from the fermentation media compared to M7101 (FIGS. 17A and 17B). In addition, the cell mass accumulation was measured in the fermentations as well as the viability of these cells after the acid washing. Cell mass accumulation from each run was measured as the difference between the started wet weight (5 g) and the final wet pellet weight in each of the reactors. Viability of the cell population was measured post-acid treatment using a Cellometer that stains for live and dead cells. M7772 showed similar biomass accumulation as wild-type M7101 (FIG. 17D) and similar viability (within 4%) after acid treatment as M7101 (FIG. 17C). This data suggests that glycerol uptake by STL1 leads to an increase in ethanol yield in the Brazil cane ethanol fermentations, and these cells are able to withstand acid treatment and multiple rounds of cell recycle while maintaining this yield improvement.

INCORPORATION BY REFERENCE

All of the references cited herein are hereby incorporated by reference in their entirety.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (229 sequences)

SEQ ID NO: 1 - DNA, 2139 bp, Saccharomyces cerevisiae
  misc_feature: ACS1
atgtcgccctctgccgtacaatcatcaaaactagaagaacagtcaagtgaaattgacaagttgaaagcaaaaatgtcccagtctgcctccactgcgcagcagaagaaggaacatgagtatgaacatttgacctcggtcaagatcgtgccacaacggcccatctcagatagactgcagcccgcaattgctacccactattctccacacttggacgggttgcaggactatcagcgcttgcacaaggagtctattgaagaccctgctaagttcttcggttctaaagctacccaatttttaaactggtctaagccattcgataaggtgttcatcccagaccctaaaacgggcaggccctccttccagaacaatgcatggttcctcaacggccaattaaacgcctgttacaactgtgttgacagacatgccttgaagacccctaacaagaaagccattattttcgaaggtgacgagcctggccaaggctattccattacctacaaggaactacttgaagaagtttgtcaagtggcacaagtgctgacttactctatgggcgttcgcaagggcgatactgttgccgtgtacatgcctatggtcccagaagcaatcataaccttgttggccatttcccgtatcggtgccattcactccgtagtctttgccgggttttcttccaactccttgagagatcgtatcaacgatggggactctaaagttgtcatcactacagatgaatccaacagaggtggtaaagtcattgagactaaaagaattgttgatgacgcgctaagagagaccccaggcgtgagacacgtcttggtttatagaaagaccaacaatccatctgttgctttccatgcccccagagatttggattgggcaacagaaaagaagaaatacaagacctactatccatgcacacccgttgattctgaggatccattattcttgttgtatacgtctggttctactggtgcccccaagggtgttcaacattctaccgcaggttacttgctgggagctttgttgaccatgcgctacacttttgacactcaccaagaagacgttttcttcacagctggagacattggctggattacaggccacacttatgtggtttatggtcccttactatatggttgtgccactttggtctttgaagggacgcctgcatacccaaattactcccgttattgggatattattgatgaacacaaagtcacccaattttatgttgcgccaactgctttgcgtttgttgaaaagagctggtgattcctacatcgaaaatcattccttaaaatctttgcgttgcttgggttcggtcggtgagccaattgctgctgaagtttgggagtggtactctgaaaaaataggtaaaaatgaaatccccattgtagacacctactggcaaacagaatctggttcgcatctggtcaccccgctggctggtggtgtcacaccaatgaaaccgggttctgcctcattccccttcttcggtattgatgcagttgttcttgaccctaacactggtgaagaacttaacaccagccacgcagagggtgtccttgccgtcaaagctgcatggccatcatttgcaagaactatttggaaaaatcatgataggtatctagacacttatttgaacccttaccctggctactatttcactggtgatggtgctgcaaaggataaggatggttatatctggattttgggtcgtgtagacgatgtggtgaacgtctctggtcaccgtctgtctaccgctgaaattgaggctgctattatcgaagatccaattgtggccgagtgtgctgttgtcggattcaacgatgacttgactggtcaagcagttgctgcatttgtggtgttgaaaaacaaatctagttggtccaccgcaacagatgatgaattacaagatatcaagaagcatttggtctttactgttagaaaagacatcgggccatttgccgcaccaaaattgatcattttagtggatgacttgcccaagacaagatctggcaaaattatgagacgtattttaagaaaaatcctagcaggagaaagtgaccaactaggcgacgtttctacattgtcaaaccctggcattgttagacatctaattgattcggtcaagttg

SEQ ID NO: 2 - protein, 713 aa, Saccharomyces cerevisiae
  misc_feature: ACS1
MSPSAVQSSKLEEQSSEIDKLKAKMSQSASTAQQKKEHEYEHLTSVKIVPQRPISDRLQPAIATHYSPHLDGLQDYQRLHKESIEDPAKFFGSKATQFLNWSKPFDKVFIPDPKTGRPSFQNNAWFLNGQLNACYNCVDRHALKTPNKKAIIFEGDEPGQGYSITYKELLEEVCQVAQVLTYSMGVRKGDTVAVYMPMVPEAIITLLAISRIGAIHSVVFAGFSSNSLRDRINDGDSKVVITTDESNRGGKVIETKRIVDDALRETPGVRHVLVYRKTNNPSVAFHAPRDLDWATEKKKYKTYYPCTPVDSEDPLFLLYTSGSTGAPKGVQHSTAGYLLGALLTMRYTFDTHQEDVFFTAGDIGWITGHTYVVYGPLLYGCATLVFEGTPAYPNYSRYWDIIDEHKVTQFYVAPTALRLLKRAGDSYIENHSLKSLRCLGSVGEPIAAEVWEWYSEKIGKNEIPIVDTYWQTESGSHLVTPLAGGVTPMKPGSASFPFFGIDAVVLDPNTGEELNTSHAEGVLAVKAAWPSFARTIWKNHDRYLDTYLNPYPGYYFTGDGAAKDKDGYIWILGRVDDVVNVSGHRLSTAEIEAAIIEDPIVAECAVVGFNDDLTGQAVAAFVVLKNKSSWSTATDDELQDIKKHLVFTVRKDIGPFAAPKLIILVDDLPKTRSGKIMRRILRKILAGESDQLGDVSTLSNPGIVRHLIDSVKL

SEQ ID NO: 3 - DNA, 2049 bp, Saccharomyces cerevisiae
  misc_feature: ASC2
atgacaatcaaggaacataaagtagttcatgaagctcacaacgtaaaggctcttaaggctcctcaacatttttacaacagccaacccggcaagggttacgttactgatatgcaacattatcaagaaatgtatcaacaatctatcaatgagccagaaaaattctttgataagatggctaaggaatacttgcattgggatgctccatacaccaaagttcaatctggttcattgaacaatggtgatgttgcatggtttttgaacggtaaattgaatgcatcatacaattgtgttgacagacatgcctttgctaatcccgacaagccagctttgatctatgaagctgatgacgaatccgacaacaaaatcatcacatttggtgaattactcagaaaagtttcccaaatcgctggtgtcttaaaaagctggggcgttaagaaaggtgacacagtggctatctatttgccaatgattccagaagcggtcattgctatgttggctgtggctcgtattggtgctattcactctgttgtctttgctgggttctccgctggttcgttgaaagatcgtgtcgttgacgctaattctaaagtggtcatcacttgtgatgaaggtaaaagaggtggtaagatcatcaacactaaaaaaattgttgacgaaggtttgaacggagtcgatttggtttcccgtatcttggttttccaaagaactggtactgaaggtattccaatgaaggccggtagagattactggtggcatgaggaggccgctaagcagagaacttacctacctcctgtttcatgtgacgctgaagatcctctatttttgttatacacttccggttccactggttctccaaagggtgtcgttcacactacaggtggttatttattaggtgccgctttaacaactagatacgtttttgatattcacccagaagatgttctcttcactgccggtgacgtcggctggatcacgggtcacacctatgctctatatggtccattaaccttgggtaccgcctcaataattttcgaatccactcctgcctacccagattatggtagatattggagaattatccaacgtcacaaggctacccatttctatgtggctccaactgctttaagattaatcaaacgtgtaggtgaagccgaaattgccaaatatgacacttcctcattacgtgtcttgggttccgtcggtgaaccaatctctccagacttatgggaatggtatcatgaaaaagtgggtaacaaaaactgtgtcatttgtgacactatgtggcaaacagagtctggttctcatttaattgctcctttggcaggtgctgtcccaacaaaacctggttctgctaccgtgccattctttggtattaacgcttgtatcattgaccctgttacaggtgtggaattagaaggtaatgatgtcgaaggtgtccttgccgttaaatcaccatggccatcaatggctagatctgtttggaaccaccacgaccgttacatggatacttacttgaaaccttatcctggtcactatttcacaggtgatggtgctggtagagatcatgatggttactactggatcaggggtagagttgacgacgttgtaaatgtttccggtcatagattatccacatcagaaattgaagcatccatctcaaatcacgaaaacgtctcggaagctgctgttgtcggtattccagatgaattgaccggtcaaaccgtcgttgcatatgtttccctaaaagatggttatctacaaaacaacgctactgaaggtgatgcagaacacatcacaccagataatttacgtagagaattgatcttacaagttaggggtgagattggtcctttcgcctcaccaaaaaccattattctagttagagatctaccaagaacaaggtcaggaaagattatgagaagagttctaagaaaggttgcttctaacgaagccgaacagctaggtgacctaactactttggccaacccagaagttgtacctgccatcatttctgctgtagagaaccaatttttctctcaaaaaaagaaa

SEQ ID NO: 4 - protein, 683 aa, Saccharomyces cerevisiae
  misc_feature: ACS2
MTIKEHKVVHEAHNVKALKAPQHFYNSQPGKGYVTDMQHYQEMYQQSINEPEKFFDKMAKEYLHWDAPYTKVQSGSLNNGDVAWFLNGKLNASYNCVDRHAFANPDKPALIYEADDESDNKIITFGELLRKVSQIAGVLKSWGVKKGDTVAIYLPMIPEAVIAMLAVARIGAIHSVVFAGFSAGSLKDRVVDANSKVVITCDEGKRGGKIINTKKIVDEGLNGVDLVSRILVFQRTGTEGIPMKAGRDYWWHEEAAKQRTYLPPVSCDAEDPLFLLYTSGSTGSPKGVVHTTGGYLLGAALTTRYVFDIHPEDVLFTAGDVGWITGHTYALYGPLTLGTASIIFESTPAYPDYGRYWRIIQRHKATHFYVAPTALRLIKRVGEAEIAKYDTSSLRVLGSVGEPISPDLWEWYHEKVGNKNCVICDTMWQTESGSHLIAPLAGAVPTKPGSATVPFFGINACIIDPVTGVELEGNDVEGVLAVKSPWPSMARSVWNHHDRYMDTYLKPYPGHYFTGDGAGRDHDGYYWIRGRVDDVVNVSGHRLSTSEIEASISNHENVSEAAVVGIPDELTGQTVVAYVSLKDGYLQNNATEGDAEHITPDNLRRELILQVRGEIGPFASPKTIILVRDLPRTRSGKIMRRVLRKVASNEAEQLGDLTTLANPEVVPAIISAVENQFFSQKKK

SEQ ID NO: 5 - DNA, 2025 bp, Zygosaccharomyces Bailii
  misc_feature: ACS
atgactgttaaggaacacaaggttgttcacgaagctcaaaacgttgaagctttgcacgctccagaacacttctacaagtctcaaccaggtccatcttacatcaaggacatgaagcaatacaaggaaatgtacaagcaatctgttgaagacccagaaaacttcttcggtgaaaaggctagagaattgttggactgggacagaccattcactagatctaagtacggttctttggaaaacggtgacgttacttggttcttgaacggtgaattgaacgctgcttacaactgtgttgacagacacgctttcgctaacccagacaagccagctttgatctacgaagctgacgaagaagctgacaacagaatgatcactttctctgaattgttgagacaagtttctagagttgctggtgttttgcaatcttggggtgttaagaagggtgacactgttgctgtttacttgccaatgatcccagaagctgttgttgctatgttggctatcgctagattgggtgctatccactctgttgttttcgctggtttctctgctggttctttgaaggacagagttgttgacgctggttgtaaggttgttatcacttgtgacgaaggtaagagaggtggtaagactgttcacactaagaagatcgttgacgaaggtttgaacggtatctctttggtttctcacatcttggttttccaaagaactggttctgaaggtatcccaatgactgctggtagagactactggtggcacgaagaaactgctaagcaaagatcttacttgccaccagttccatgtaactctgaagacccattgttcttgttgtacacttctggttctactggttctccaaagggtgttgttcactctactgctggttacttgttgggtgctgctatgactactagatacgttttcgacatccacccagaagacgttttgttcactgctggtgacgttggttggatcactggtcacacttacgctttgtacggtccattggttttgggtactgcttctatcatcttcgaatctactccagcttacccagactacggtagatactggagaatcatccaaagacacaaggctactcacttctacgttgctccaactgctttgagattgatcaagagagttggtgaagctgaaatcccaaagtacgacatctcttctttgagagttttgggttctgttggtgaaccaatctctccagaattgtgggaatggtactacgaaaaggttggtaacaagaactgtgttatctgtgacactatgtggcaaactgaatctggttctcacttgatcgctccacaagctggtgctgttccaactaagccaggttctgctactgttccattcttcggtgttgacgcttgtatcatcgacccagttactggtatcgaattgcaaggtaacgacgttgaaggtgttttggctgttaagtcttcttggccatctatggctagatctgtttggcaaaaccaccacagatacgttgacacttacttgaagccatacccaggttactacttcactggtgacggtgctggtagagaccacgacggttactactggatcagaggtagagttgacgacgttgttaacgtttctggtcacagattgtctactgctgaaatcgaagcttctttgactaaccacgacaacgtttctgaatctgctgttgttggtatcgctgacgaattgactggtcaatctgttatcgctttcgtttctttgaaggacggttcttctagagaatcttctgctgttgttgctatgagaagagaattggttttgcaagttagaggtgaaatcggtccattcgctgctccaaagtgtgttatcttggttaaggacttgccaaagactagatctggtaagatcatgagaagagttttgagaaaggttgcttctaacgaagctgaccaattgggtgacttgtctactatggctaactctgaagttgttccatctatcatcgctgctgttgacgaacaattcttcgctgaaaagaagaag

SEQ ID NO: 6 - protein, 675 aa, Zygosaccharomyces Bailii
  misc_feature: ACS
MTVKEHKVVHEAQNVEALHAPEHFYKSQPGPSYIKDMKQYKEMYKQSVEDPENFFGEKARELLDWDRPFTRSKYGSLENGDVTWFLNGELNAAYNCVDRHAFANPDKPALIYEADEEADNRMITFSELLRQVSRVAGVLQSWGVKKGDTVAVYLPMIPEAVVAMLAIARLGAIHSVVFAGFSAGSLKDRVVDAGCKVVITCDEGKRGGKTVHTKKIVDEGLNGISLVSHILVFQRTGSEGIPMTAGRDYWWHEETAKQRSYLPPVPCNSEDPLFLLYTSGSTGSPKGVVHSTAGYLLGAAMTTRYVFDIHPEDVLFTAGDVGWITGHTYALYGPLVLGTASIIFESTPAYPDYGRYWRIIQRHKATHFYVAPTALRLIKRVGEAEIPKYDISSLRVLGSVGEPISPELWEWYYEKVGNKNCVICDTMWQTESGSHLIAPQAGAVPTKPGSATVPFFGVDACIIDPVTGIELQGNDVEGVLAVKSSWPSMARSVWQNHHRYVDTYLKPYPGYYFTGDGAGRDHDGYYWIRGRVDDVVNVSGHRLSTAEIEASLTNHDNVSESAVVGIADELTGQSVIAFVSLKDGSSRESSAVVAMRRELVLQVRGEIGPFAAPKCVILVKDLPKTRSGKIMRRVLRKVASNEADQLGDLSTMANSEVVPSIIAAVDEQFFAEKKK

SEQ ID NO: 7 - DNA, 2025 bp, Salmonella enterica; identical to SEQ ID NO: 5
  misc_feature: ACS

SEQ ID NO: 8 - protein, 675 aa, Salmonella enterica; identical to SEQ ID NO: 6
  misc_feature: ACS

SEQ ID NO: 9 - DNA, 1713 bp, Pichia sorbitophila
  misc_feature: STL1
atgggattcgaactttggggaaggaccaacacaggtggtttgagaggtagacctcttcgtgttgccatcaccgctgttgcaactactggtttctcccttttcggttatgatcagggtttgatgtctggtattattaccggtactgaatttaacgaggagttccctccaacctggtccaagccacattacaacgcgtctgagaagagacatgctactgttgttcaaggtgctgttacagcttgttacgaaattggttgtttcttcggtgctctttttgctttggttagaggtgacaggatcggtagacgtccacttgtcattgttggtgctgttcttatcatcattggtactgttatttctactgctgcttttggtgaacactggggtttgggtcaattcgttattggtagagttattactggtattggtaacggtatgaacacagcaactatcccagtctggcaatctgagatctctcgtccagaaaacagaggtaagttagtcaacttggaaggttcagtcattgccattggtactttcgttgcttactggattgatttcggtctctcctacgttaacagctctgtacaatggagattccctgttgcgttccaaattgtttttgctgctggacttcttggaggtattcttttcatgccggagtctcctagatggttgctcgctcatggcaagaaggagcaagcacacatagtcttaggtgctttgaatgatctcgaccctaatgatgaccatgtccttgctgagagtactgttattaccgatgctattaacagattctccaggtctcaacttggtttcaaggaacttatgtccggtggtaagaaccaacattttgctagaatggttattggttcttccactcaatttttccaacagttcactggttgtaatgctgccatttactattcaacagttttgttcgaagagaccattttcgtcggtgacagaagattgtctttggttatgggtggtgttttcgcttccgtatacgcccttgccactattccatctttcttcttagtcgataagcttggtagaagaaacttgttcttgattggtgctactggtcaagctttgtctttcaccattacatttgcttgtttgatcaacccaacaaagcaaaatgctaagggtgcagctgttggtatcttcttgtttatcaccttcttcgcctttacaattttgccattgccttggatttacccaccagaaatcaacccattgagaacaagaactgttgcctctgccgtttctacatgtaccaattggcttacaaactttgccgtcgttatgtttactcctattttcattaacgatgctcaatggggttgttacttgttctttgcttgtttgaactacgctttcattccagttatcttctggttctacccagaaactgctggccgttccttggaagaaattgatatcattttcgcgaaggcttacactgatggaagacctccatggagagttgctgctaccatgccacacttgtctttgaaggaacaagaggagcaaggtatgcaactcggactttatgacaatgaagctgagaaacagaagttcgagcaaaccgagaacttgatgtcttctagctcttctgcgaagcttcctgaagagggatctaacgtaaacgagaatgagaacgaaaacacgaacgaaaaggatcaaacaccaaagccaactgatgtt

SEQ ID NO: 10 - protein, 571 aa, Pichia sorbitophila
  misc_feature: STL1
MGFELWGRTNTGGLRGRPLRVAITAVATTGFSLFGYDQGLMSGIITGTEFNEEFPPTWSKPHYNASEKRHATVVQGAVTACYEIGCFFGALFALVRGDRIGRRPLVIVGAVLIIIGTVISTAAFGEHWGLGQFVIGRVITGIGNGMNTATIPVWQSEISRPENRGKLVNLEGSVIAIGTFVAYWIDFGLSYVNSSVQWRFPVAFQIVFAAGLLGGILFMPESPRWLLAHGKKEQAHIVLGALNDLDPNDDHVLAESTVITDAINRFSRSQLGFKELMSGGKNQHFARMVIGSSTQFFQQFTGCNAAIYYSTVLFEETIFVGDRRLSLVMGGVFASVYALATIPSFFLVDKLGRRNLFLIGATGQALSFTITFACLINPTKQNAKGAAVGIFLFITFFAFTILPLPWIYPPEINPLRTRTVASAVSTCTNWLTNFAVVMFTPIFINDAQWGCYLFFACLNYAFIPVIFWFYPETAGRSLEEIDIIFAKAYTDGRPPWRVAATMPHLSLKEQEEQGMQLGLYDNEAEKQKFEQTENLMSSSSSAKLPEEGSNVNENENENTNEKDQTPKPTDV

SEQ ID NO: 11 - DNA, 1680 bp, Saccharomyces cerevisiae
  misc_feature: GUP1
atgtcgctgatcagcatcctgtctcccctagttacttccgagggcttagattcaagaatcaaaccttcaccaaaaaaggatgcctctactactactaagccatcactatggaaaactactgagttcaaattctactacattgcatttttggtcgtggttcccttgatgttctatgctgggttacaagctagttcgcccgaaaatccaaactatgcaagatacgaacgtctcctatctcaaggttggttatttggcagaaaagtagacaatagtgattctcaatataggtttttcagggacaattttgcgctattgtcagttttaatgctagtccacacttctataaaacgcattgtactttattcaacaaatatcactaaattgaggtttgatctgatatttggtttgatctttttagtggccgctcatggtgtcaattcgataagaattttagcccatatgctaattttatatgccatcgcccatgtactaaagaactttagaagaatagccaccatcagcatttggatttatggtatttctacgctttttattaacgacaacttcagagcatatccatttggtaatatttgctcttttttaagcccattggaccattggtatagaggtatcattccaagatgggatgtctttttcaattttactcttttgagagtcttaagttacaacttggacttcttagagaggtgggagaatttacaaaagaagaaaagtccatcctatgaatcaaaagaagctaaatcagccattttgctcaatgaacgtgctagattaactgctgcacaccccatacaggactacagcttaatgaattatattgcatatgttacttacacgccacttttcattgccggccccattataacattcaatgattatgtttaccaatcgaaacataccttgccatcaataaatttcaaattcattttttactatgcggtgagattcgttattgctctcttatctatggagttcattttacactttctctacgttgtggcaatctcaaaaaccaaagcgtgggaaaatgacacacctttccagatttccatgattggcttatttaatttgaatattatttggctaaaactactgattccgtggaggctgtttaggctgtgggctttgctagacggaatcgatacacctgaaaatatgatcaggtgtgttgataacaattacagttcactagcattctggagagcttggcataggagctacaataagtgggttgtccgttacatatatattcctctaggtggctcaaaaaatagagttttgacatcactagcagtcttttccttcgtagctatatggcatgacatcgaactaaagttattattatggggttggctaatagttttgttcctcttaccagaaatttttgctacccaaattttctctcattataccgacgcagtctggtacagacacgtttgcgctgtcggtgctgttttcaacatatgggttatgatgatcgctaatctttttggattctgcttgggctctgacggtactaaaaaattactaagcgatatgttctgtaccgtatctggtttcaaatttgtaattttggcaagcgttagtttattcatcgcagtacaaataatgtttgaaatcagagaagaagaaaagaggcacggaatttacctaaaatgc

SEQ ID NO: 12 - protein, 560 aa, Saccharomyces cerevisiae
  misc_feature: GUP1
MSLISILSPLVTSEGLDSRIKPSPKKDASTTTKPSLWKTTEFKFYYIAFLVVVPLMFYAGLQASSPENPNYARYERLLSQGWLFGRKVDNSDSQYRFFRDNFALLSVLMLVHTSIKRIVLYSTNITKLRFDLIFGLIFLVAAHGVNSIRILAHMLILYAIAHVLKNFRRIATISIWIYGISTLFINDNFRAYPFGNICSFLSPLDHWYRGIIPRWDVFFNFTLLRVLSYNLDFLERWENLQKKKSPSYESKEAKSAILLNERARLTAAHPIQDYSLMNYIAYVTYTPLFIAGPIITFNDYVYQSKHTLPSINFKFIFYYAVRFVIALLSMEFILHFLYVVAISKTKAWENDTPFQISMIGLFNLNIIWLKLLIPWRLFRLWALLDGIDTPENMIRCVDNNYSSLAFWRAWHRSYNKWVVRYIYIPLGGSKNRVLTSLAVFSFVAIWHDIELKLLLWGWLIVLFLLPEIFATQIFSHYTDAVWYRHVCAVGAVFNIWVMMIANLFGFCLGSDGTKKLLSDMFCTVSGFKFVILASVSLFIAVQIMFEIREEEKRHGIYLKC

SEQ ID NO: 13 - DNA, 3599 bp, Saccharomyces cerevisiae
  misc_feature: FPS1
  misc_feature (801)..(2810): coding sequence
ttgacggcagttctcatagcatctcaaagcaatagcagtgcaaaagtacataaccgtaggaaggtacgcggtaggtatttgagttcgttggtggttatcctccgcaaggcgcttcggcggttatttgttgatagtcgaagaacaccaaaaaaaatgctgttattgctttctccgtaaacaataaaacccggtagcgggataacgcggctgatgcttttatttaggaaggaatacttacattatcatgagaacattgtcaagggcattctgatacgggccttccatcgcaagaaaaaggcagcaacggactgagggacggagagagttacggcataagaagtagtaggagagcagagtgtcataaagttatattattctcgtcctaaagtcaattagttctgttgcgcttgacaatatatgtcgtgtaataccgtcccttagcagaagaaagaaagacggatccatatatgttaaaatgcttcagagatgtttctttaatgtgccgtccaacaaaggtatcttctgtagcttcctctattttcgatcagatctcatagtgagaaggcgcaattcagtagttaaaagcggggaacagtgtgaatccggagacggcaagattgcccggccctttttgcggaaaagataaaacaagatatattgcactttttccaccaagaaaaacaggaagtggattaaaaaatcaacaaagtataacgcctattgtcccaataagcgtcggttgttcttctttattattttaccaagtacgctcgagggtacattctaatgcattaaaagacatgagtaatcctcaaaaagctctaaacgactttctgtccagtgaatctgttcatacacatgatagttctaggaaacaatctaataagcagtcatccgacgaaggacgctcttcatcacaaccttcacatcatcactctggtggtactaacaacaataataacaataataataataataataacagtaacaacaacaacaacggcaacgatgggggaaatgatgacgactatgattatgaaatgcaagattatagaccttctccgcaaagtgcgcggcctactcccacgtatgttccacaatattctgtagaaagtgggactgctttcccgattcaagaggttattcctagcgcatacattaacacacaagatataaaccataaagataacggtccgccgagtgcaagcagtaatagagcattcaggcctagagggcagaccacagtgtcggccaacgtgcttaacattgaagatttttacaaaaatgcagacgatgcgcataccatcccggagtcacatttatcgagaaggagaagtaggtcgagggctacgagtaatgctgggcacagtgccaatacaggcgccacgaatggcaggactactggtgcccaaactaatatggaaagcaatgaatcaccacgtaacgtccccattatggtgaagccaaagacattataccagaaccctcaaacacctacagtcttgccctccacataccatccaattaataaatggtcttccgtcaaaaacacttatttgaaggaatttttagccgagtttatgggaacaatggttatgattattttcggtagtgctgttgtttgtcaggtcaatgttgctgggaaaatacagcaggacaatttcaacgtggctttggataaccttaacgttaccgggtcttctgcagaaacgatagacgctatgaagagtttaacatccttggtttcatccgttgcgggcggtacctttgatgatgtggcattgggctgggctgctgccgtggtgatgggctatttctgcgctggtggtagtgccatctcaggtgctcatttgaatccgtctattacattagccaatttggtgtatagaggttttcccctgaagaaagttccttattactttgctggacaattgatcggtgccttcacaggcgctttgatcttgtttatttggtacaaaagggtgttacaagaggcatatagcgattggtggatgaatgaaagtgttgcgggaatgttttgcgtttttccaaagccttatctaagttcaggacggcaatttttttccgaatttttatgtggagctatgttacaagcaggaacatttgcgctgaccgatccttatacgtgtttgtcctctgatgttttcccattgatgatgtttattttgattttcattatcaatgcttccatggcttatcagacaggtacagcaatgaatttggctcgtgatctgggcccacgtcttgcactatatgcagttggatttgatcataaaatgctttgggtgcatcatcatcatttcttttgggttcccatggtaggcccatttattggtgcgttaatgggggggttggtttacgatgtctgtatttatcagggtcatgaatctccagtcaactggtctttaccagtttataaggaaatgattatgagagcctggtttagaaggcctggttggaagaagagaaatagagcaagaagaacatcggacctgagtgacttctcatacaataacgatgatgatgaggaatttggagaaagaatggctcttcaaaagacaaagaccaagtcatctatttcagacaacgaaaatgaagcaggagaaaagaaagtgcaatttaaatctgttcagcgcggcaaaagaacgtttggtggtataccaacaattcttgaagaagaagattccattgaaactgcttcgctaggtgcgacgacgactgattctattgggttatccgacacatcatcagaagattcgcattatggtaatgctaagaaggtaacatgagaaaacagacaagaaaaagaaacaaataatatagactgatagaaaaaaatactgcttactaccgccggtataatatatatatatatatatatttacatagatgattgcatagtgttttaaaaagctttcctaggttaagctatgaatcttcataacctaaccaactaaatatgaaaatactgacccatcgtcttaagtaagttgacatgaactcagcctggtcacctactatacatgatgtatcgcatggatggaaagaataccaaacgctaccttccaggttaatgatagtatccaaacctagttggaatttgccttgaacatcaagcagcgattcgatatcagttgggagcatcaatttggtcattggaataccatctatgcttttctcctcccatattcgcaaaagtagtaagggctcgttatatacttttgaatatgtaagatataattctatatgatttagtaatttattttctatacgctcagtatttttctgcagttgtcgagtaggtattaaacgcaaaagaagtccatccttttcatcattcaaatggacatcttggcaaagggcccagttatggaaaatctgggagtcatacaacgattgcagttggctatgccactcctggtaaggaatcatcaagtctgataattctgttttttagccctttttttttttttttcatggtgttctcttctcattgcttttcaattttaagttcgttacctttcatatagagtttcttaacagaaatttcacaacgaaaatataattaactacaggca

SEQ ID NO: 14 - protein, 669 aa, Saccharomyces cerevisiae
  MISC_FEATURE: FPS1
MSNPQKALNDFLSSESVHTHDSSRKQSNKQSSDEGRSSSQPSHHHSGGTNNNNNNNNNNNNSNNNNNGNDGGNDDDYDYEMQDYRPSPQSARPTPTYVPQYSVESGTAFPIQEVIPSAYINTQDINHKDNGPPSASSNRAFRPRGQTTVSANVLNIEDFYKNADDAHTIPESHLSRRRSRSRATSNAGHSANTGATNGRTTGAQTNMESNESPRNVPIMVKPKTLYQNPQTPTVLPSTYHPINKWSSVKNTYLKEFLAEFMGTMVMIIFGSAVVCQVNVAGKIQQDNFNVALDNLNVTGSSAETIDAMKSLTSLVSSVAGGTFDDVALGWAAAVVMGYFCAGGSAISGAHLNPSITLANLVYRGFPLKKVPYYFAGQLIGAFTGALILFIWYKRVLQEAYSDWWMNESVAGMFCVFPKPYLSSGRQFFSEFLCGAMLQAGTFALTDPYTCLSSDVFPLMMFILIFIINASMAYQTGTAMNLARDLGPRLALYAVGFDHKMLWVHHHHFFWVPMVGPFIGALMGGLVYDVCIYQGHESPVNWSLPVYKEMIMRAWFRRPGWKKRNRARRTSDLSDFSYNNDDDEEFGERMALQKTKTKSSISDNENEAGEKKVQFKSVQRGKRTFGGIPTILEEEDSIETASLGATTTDSIGLSDTSSEDSHYGNAKKVT

SEQ ID NO: 15 - DNA, 2001 bp, Saccharomyces cerevisiae
  misc_feature: consitutively active FPS1
atgagtaatcctcaaaaagctctaaacgactttctgtccagtgaatctgttcatacacatgatagttctaggaaacaatctaataagcagtcatccgacgaaggacgctcttcatcacaaccttcacatcatcactctggtggtactaacaacaataataacaataataataataataacagtaacaacaacaacggcaacgatgggggaaatgatgacgactatgattatgaaatgcaagattataggccttctccgcaaagtgcgcggcctactcccacgtatgttccacaatattctgtagaaagtggggctgctttcccgattcaagaggttattcctaacgcatacattaacacacaagatataaaccataaagataacggtccgccgagtgcaagcagtaatagagcattcaggcctagagggcagaccacagtgtcggccaacgtgcttaacattgaagatttttacaaaaatgcagacgatgcgcataccatcccggagtcacatttatcgagaaggagaagtaggtcgagggctacgagtaatgctgggcacagtgccaatacaggcgccacgaatggtaggactactggtgcccaaactaatatggaaagcaatgaatcaccacgtaacgtccccattatggtgaagccaaagacattataccagaaccctcaaacacctacagtcttgccctccacataccatccaattaataaatggtcttccgtcaaaaacacttatttgaaggaatttttagccgagtttatgggaacaatggttatgattatttttggtagtgcagttgtttgtcaggtcaatgtagctgggaaaatacagcaggacaatttcaacgtggctttggataatcttaacgttaccgggtcttctgcagaaacgatagacgctatgaagagtttaacatccttggtttcatccgttgcgggcggtacctttgatgatgtggcattaggctgggctgctgccgtggtgatgggctatttctgcgctggtggtagtgccatctcaggtgcccatttgaatccgtctattacattagccaatttggtgtatagaggttttccgctgaagaaagttccttattactttgctggacaactgatcggtgccttcacaggcgctttgatcttgtttatttggtacaaaagggtgttgcaagaggcatatagcgattggtggatgaatgaaagtgttgcgggaatgttttgcgtttttccaaagccttatctaagttcaggacggcaatttttttccgaatttttatgtggagctatgttacaagcaggaacatttgcgctgaccgatccttatacatgtttgtcctctgatgttttcccattgatgatgtttattttgattttcattatcaatgcttccatggcttatcagacaggtacagcaatgaatttggctcgtgatctgggcccacgtcttgcactatatgcagttggatttgatcataaaatgctttgggtgcatcatcatcatttcttttgggttcccatggtaggcccatttgttggtgcgttaatgggggggttggtttacgatgtctgtatttatcagggtcatgaatctccagtcaactggtctttaccagtttataaggaaatgattatgagagcctggtttagaaggcctggttggaagaagagaaatagagcaagaagaacatcggacctgagtgacttctcatacaataacgatgatgatgaggaatttggagaaagaatggctcttcaaaagacaaagaccaagtcatctatttcagacaacgaaaatgaagcaggagaaaagaaagtgcaatttaaatctgttcagcgtggcaagagaacgtttggtggtataccaacaattcttgaagaagaagattccattgaaactgcttcgctaggtgcgacgacgactgattctattgggttatccgacacatcatcagaagattcgcattatggtaatgctaagaaggtaaca

SEQ ID NO: 16 - protein, 417 aa, Saccharomyces cerevisiae
  misc_feature: consitutively active FPS1
MSNPQKALNDFLVMIIFGSAVVCQVNVAGKIQQDNFNVALDNLNVTGSSAETIDAMKSLTSLVSSVAGGTFDDVALGWAAAVVMGYFCAGGSAISGAHLNPSITLANLVYRGFPLKKVPYYFAGQLIGAFTGALILFIWYKRVLQEAYSDWWMNESVAGMFCVFPKPYLSSGRQFFSEFLCGAMLQAGTFALTDPYTCLSSDVFPLMMFILIFIINASMAYQTGTAMNLARDLGPRLALYAVGFDHKMLWVHHHHFFWVPMVGPFIGALMGGLVYDVCIYQGHESPVNWSLPVYKEMIMRAWFRRPGWKKRNRARRTSDLSDFSYNNDDDEEFGERMALQKTKTKSSISDNENEAGEKKVQFKSVQRGKRTFGGIPTILEEEDSIETASLGATTTDSIGLSDTSSEDSHYGNAKKVT

SEQ ID NO: 17 - DNA, 759 bp, Bacillus licheniformis
  misc_feature: DSM13
atggatggaaatattcattcgatcgaaacattcggcaccgttgacggtccaggcatcaggtatgtcgtcttcacacaaggctgcctgatgcgctgtcaattttgccataatgctgatacttgggaaatcggaaccggaaaacaaatgacggtttccgaaatcgttcaggatgtccagcattatctcccgtttattcaatcatcgggcggaggcatcaccgtgagcggaggcgagccgcttttacaactgccgtttttaatcgagctgttcaaagcatgcaaaagcctcggcattcacacggcactcgattcgtccggcggatgctattcggctgcgccggcatttcaagagcagatcaaagaactgatccagtatacagaccttgttttgcttgacctcaagcatcacaacagaaaaaaacatatcaacctgacaggaatgccgaatgaccacattttagaatttgcccggtttctcgctgaacatcaagttcccgtctggatccgccacgtactggttccggggatctccgatatcgatgccgatttaacggccctcggcacgtttatcggcacgcttgcgaacgttcagaaggtggaggttcttccttatcacaagctcggcgtctacaaatgggaagcgcttggcctggattatccgttaaaaggggttgaaccgccaagtgccgacagggccgaaaatgcgtacagactgctcaccgcacacttgcaaggcggatccttgctgcaagagacataa

SEQ ID NO: 18 - protein, 252 aa, Bacillus licheniformis
  MISC_FEATURE: DSM13
MDGNIHSIETFGTVDGPGIRYVVFTQGCLMRCQFCHNADTWEIGTGKQMTVSEIVQDVQHYLPFIQSSGGGITVSGGEPLLQLPFLIELFKACKSLGIHTALDSSGGCYSAAPAFQEQIKELIQYTDLVLLDLKHHNRKKHINLTGMPNDHILEFARFLAEHQVPVWIRHVLVPGISDIDADLTALGTFIGTLANVQKVEVLPYHKLGVYKWEALGLDYPLKGVEPPSADRAENAYRLLTAHLQGGSLLQET

SEQ ID NO: 19 - DNA, 759 bp, Bacillus licheniformis; identical to SEQ ID NO: 17
  misc_feature: ATCC14580

SEQ ID NO: 20 - protein, 252 aa, Bacillus licheniformis; identical to SEQ ID NO: 18
  MISC_FEATURE: ATCC14580

SEQ ID NO: 21 - DNA, 801 bp, Streptococcus thermophilus
  misc_feature: CNRZ1066
atggcagaaattgattacagtcaggtgactggacttgttcattcaaccgaaagtttcggatccgtagatggtcctggtatccgttttattgtgtttatgcaaggctgtaagctgcgttgccaatattgtcataacccagatacttgggccatgaagtcaaataaggctgttgaacgtacagttgaagatgtcttagaagaggctcttcgcttccgtcatttctggggtgagcatggtggaatcactgtatcaggtggtgaagccatgcttcagattgattttgtcactgccctctttacagaggctaagaagttagggattcactgtacgcttgatacgtgtggcttgtcttatcgtaatactccagagtatcatgaagttgtcgacaaacttttggctgtaactgacttggttctactggatatcaaagagattgaccccgaacaacacaagtttgtgacccgtcaacctaataagaatatcttggaatttgctcaatatctgtctgataaacaagttccggtctggattcgtcatgtcttggtacctggtttgacagattttgacgaacacttggttaagctcggcgagtttgtaaagaccttgaaaaatgtcgataaatttgaaattcttccatatcatacgatgggggaattcaagtggcgtgaacttggcatcccttatccattggaaggtgtcaaaccaccaactgcagatcgtgttaaaaatgctaaggctcttatgcatacggaaacttatcaagagtataagaatcgtatcggggttaaaaccttggattaa

SEQ ID NO: 22 - protein, 266 aa, Streptococcus thermophilus
  MISC_FEATURE: CNRZ1066
MAEIDYSQVTGLVHSTESFGSVDGPGIRFIVFMQGCKLRCQYCHNPDTWAMKSNKAVERTVEDVLEEALRFRHFWGEHGGITVSGGEAMLQIDFVTALFTEAKKLGIHCTLDTCGLSYRNTPEYHEVVDKLLAVTDLVLLDIKEIDPEQHKFVTRQPNKNILEFAQYLSDKQVPVWIRHVLVPGLTDFDEHLVKLGEFVKTLKNVDKFEILPYHTMGEFKWRELGIPYPLEGVKPPTADRVKNAKALMHTETYQEYKNRIGVKTLD

SEQ ID NO: 23 - DNA, 801 bp, Streptococcus thermophilus; identical to SEQ ID NO: 21
  misc_feature: LMG18311

SEQ ID NO: 24 - protein, 266 aa, Streptococcus thermophilus; identical to SEQ ID NO: 22
  MISC_FEATURE: LMG18311

SEQ ID NO: 25 - DNA, 801 bp, Streptococcus thermophilus; identical to SEQ ID NO: 21
  misc_feature: LMD-9

SEQ ID NO: 26 - protein, 266 aa, Streptococcus thermophilus; identical to SEQ ID NO: 22
  MISC_FEATURE: LMD-9

SEQ ID NO: 27 - DNA, 804 bp, Lactobacillus plantarum
  misc_feature: WCFS1
atgccaacgatcacaactaagacgcccgtaaaaggactaatatttaacattcaaaaatttagtatcaatgatggaccaggtattcgaacagtagttttctttaaagggtgcccgttacgctgcaagtggtgttctaatccagaatcacaatcaggtgagcaagaatcaatgtatgatgaacagaccgccaagcaaaccatcgtcggtgattatatgacggttgatgatattatgaaagttattctacaagataaagacttctatgaagagtctggcggtggggtaaccttctctggtggtgaagttctttttcaagcttcctttgcgattgagcttgctaaggcagttaaagcagctggcattaatttagcctgtgagacaactggttacgcacggcctaaggtttttaatgaattcatgtcttatatggacttcatgtattatgactgtaaacaatgggacccagcccaacatcgaatcggaacgggtgccgataacggggtaattttacgtaacttagcaactgcagtgcaagctcatcaaaagatgatggttcggattccggttattccaggttttaattatacattgaatgacgcggatcattttggacaactatttaatcagattggcgtaaccgaagttgaattattgccatttcaccagtttgggttgaaaaagtatcaagatttgggccgaaaatatgcgctagttaatgttaaacagttacaagcggatgacttaattgattatgctgaacatattcgtgcacatggtgttaaagtacgggtgaatgggtggtaa

SEQ ID NO: 28 - protein, 267 aa, Lactobacillus plantarum
  MISC_FEATURE: WCFS1
MPTITTKTPVKGLIFNIQKFSINDGPGIRTVVFFKGCPLRCKWCSNPESQSGEQESMYDEQTAKQTIVGDYMTVDDIMKVILQDKDFYEESGGGVTFSGGEVLFQASFAIELAKAVKAAGINLACETTGYARPKVFNEFMSYMDFMYYDCKQWDPAQHRIGTGADNGVILRNLATAVQAHQKMMVRIPVIPGFNYTLNDADHFGQLFNQIGVTEVELLPFHQFGLKKYQDLGRKYALVNVKQLQADDLIDYAEHIRAHGVKVRVNGW

SEQ ID NO: 29 - DNA, 822 bp, Lactobacillus plantarum
  misc_feature: WCFS1
atggaaaacaaacaagtttcaacaacgcaagcggcggcaaaggagcctttgataggctacgttcactccatcgaaacgtttggctccgttgacggaccaggtatccgttacgtggcattccttcaaggatgccacatgcgttgccaatactgtcacaaccctgatacttggaaactcaacgttggcgatcaaatgacggccgacgagattctcgaagacgcggctaaataccgggctttctggggcaagacgggtggcatcacagtcagtggtggtgaatcactggtacaaatcgacttcatcttagacttattcgaaaaagccaaggcgatgaatatcagtacttgtctggatacctctggacagccttttacccgagaacaacctttctttgacaagttcgaacgtctaatgaaggtcacggacatttcgttggtcgacattaagcacatcgattctgccaaacacaagcagttgacccagtatgggaacgaaaatatcttggatatgattcagtacatggcccaacaccacgatgatatgtggattcgtcacgtcctggttccccaacggactgattacgatgaagacttgaagaaactcggcgattacattgctaaaattccaaacgacgtcgttcaaaaagtcgaagtattgccgtaccatactttgggcgttaaaaaatatcatgaaatgaagatcaagtaccggcttgaaggaatcgagtctccaacccaagatcgggtggcaaatgccgaaaagctactgcacactgctgattacaacgggtacaagacatggatgccattgccaaaactttaa

SEQ ID NO: 30 - protein, 273 aa, Lactobacillus plantarum
  MISC_FEATURE: WCFS1
MENKQVSTTQAAAKEPLIGYVHSIETFGSVDGPGIRYVAFLQGCHMRCQYCHNPDTWKLNVGDQMTADEILEDAAKYRAFWGKTGGITVSGGESLVQIDFILDLFEKAKAMNISTCLDTSGQPFTREQPFFDKFERLMKVTDISLVDIKHIDSAKHKQLTQYGNENILDMIQYMAQHHDDMWIRHVLVPQRTDYDEDLKKLGDYIAKIPNDVVQKVEVLPYHTLGVKKYHEMKIKYRLEGIESPTQDRVANAEKLLHTADYNGYKTWMPLPKL

SEQ ID NO: 31 - DNA, 822 bp, Lactobacillus plantarum
  misc_feature: JDM1
atggaaaacaaacaagtttcaacaacgcaagcggcggcaaaagagcctttgataggctacgttcactccatcgaaacgtttggctccgttgacggaccaggtatccgttacgtggcattccttcaaggatgccacatgcgttgccaatactgtcacaaccctgatacttggaaactcaacgttggcgatcaaatgacggccgacgagattctcgaagacgcggctaaataccgggctttctggggcaagacgggtggcatcacagtcagtggtggtgaatcactggtacaaatcgacttcatcttagacttattcgaaaaagccaaggcgatgaatatcagtacttgtctggatacctctggacagccttttacccgagaacaacctttctttgacaagttcgaacgtctaatgaaggtcacggacatttcgttggtcgacattaagcacatcgattctgccaaacacaagcagttgacccagtatgggaacgaaaatatcttggatatgattcagtacatggcccaacaccacgatgatatgtggattcgtcacgtcctggttccccaacggactgattacgatgaagacttgaagaaactcggcgattacattgctaagattccaaacgacgtcgttcaaaaagtcgaagtattgccgtaccatactttgggcgttaaaaaatatcatgaaatgaagatcaagtaccggcttgaaggaatcgagtctccaacccaagatcgggtggcaaatgccgaaaagctactgcacactgctgattacaacgggtacaagacatggatgccattgccaaaactttaa

SEQ ID NO: 32 - protein, 273 aa, Lactobacillus plantarum; identical to SEQ ID NO: 30
  MISC_FEATURE: JDM1

SEQ ID NO: 33 - DNA, 804 bp, Lactobacillus plantarum; identical to SEQ ID NO: 27
  misc_feature: JDM1

SEQ ID NO: 34 - protein, 267 aa, Lactobacillus plantarum; identical to SEQ ID NO: 28
  MISC_FEATURE: JDM1

SEQ ID NO: 35 - DNA, 852 bp, Lactobacillus casei
  misc_feature: bl23
atgaaactcatcgatcagtcacaaagcccattaaatatcttagaacaagttggtcaggatcatgatggcccgatcaaagggtatgttcactcggtcgaaagttttggttcggtcgatggccctggtattcgcttcgttgtctttatgcaagggtgtcgcatgcgttgccagtattgtcacaaccctgacacctggaacattggggttggtgaagaaatgacggccgatcaaattttggcggatgcccagcgctataaagcattctggggtgaccaagggggtattacctgcagtggcggtgagagtttggtacaaatcgatttcattctcgaactcttcaccaaggctaaggcactgggaatttcgacttgcctcgatacgtcaggtggccccttcacgcgtgaccaaccgtggtttggccagtttgaaaagctgatggctgttactgacatctcattagttgatattaaacacattgattcggccgagcataaaaagctcaccggttttcctaatgagaatattttggatatggtgcagtatatgtcggcgcatggtgatgacatgtggattcgccacgttctggtcccggaacgcactgactttgacccttatctcaaacggttaggggactatattgcgacattggacaaaaacgtggtccaaaaagttgagattctgccgtatcacacgttaggcgttaaaaagtatcacgagcttggcattacgtacccgcttgaaggcatcgaaccgccgtctgccgaacgcgttaagaatgcagagaatctgctgcacgttaaggattataccggatggcaaagctggcgtccgaaaccagttgcgagcaactga

SEQ ID NO: 36 - protein, 283 aa, Lactobacillus casei
  MISC_FEATURE: bl23
MKLIDQSQSPLNILEQVGQDHDGPIKGYVHSVESFGSVDGPGIRFVVFMQGCRMRCQYCHNPDTWNIGVGEEMTADQILADAQRYKAFWGDQGGITCSGGESLVQIDFILELFTKAKALGISTCLDTSGGPFTRDQPWFGQFEKLMAVTDISLVDIKHIDSAEHKKLTGFPNENILDMVQYMSAHGDDMWIRHVLVPERTDFDPYLKRLGDYIATLDKNVVQKVEILPYHTLGVKKYHELGITYPLEGIEPPSAERVKNAENLLHVKDYTGWQSWRPKPVASN

SEQ ID NO: 37 - DNA, 852 bp, Lactobacillus casei
  misc_feature: ATCC 334
atgaaactcatcgatcagtcacaaagcccattaaatatcttagaacaagttggtcaggatcatgatggcccgatcaaagggtatgttcactcggtcgaaagttttggttcggtcgatggccctggtattcgcttcgttgtctttatgcaagggtgtcgcatgcgttgccagtattgtcacaaccctgacacctggaacattggggttggtgaagaaatgacggccgatcaaattttggcggatgcccagcgctataaagcattctggggtgaccaagggggtattacgtgcagtggcggtgagagtttggtacaaatcgatttcattctcgaactcttcaccaaggctaaggcactgggaatttcgacttgcctcgatacgtcaggcggccccttcacgcgtgaccaaccgtggtttggccagtttgaaaagctgatggctgttactgacatctcattagttgatattaaacacatcgattcggccgagcataaaaagctcaccggttttcctaatgaaaatattttagatatggtgcagtatatgtcggcgcatggtgatgacatgtggattcgccacgttctggtcccggaacgcactgactttgacccttatctcaaacgattaggggactatattgcgacattggacaaaaacgtggtccaaaaagttgagattctgccgtatcacacgttaggcgttaaaaagtatcacgagcttggcattacgtacccgcttgaaggcatcgaaccgccgtctgccgatcgcgttaagaatgcagagaatctgctgcacgttaaggattataccggatggcaaagctggcgtccgaaaccagttgcgagcaactga

SEQ ID NO: 38 - protein, 283 aa, Lactobacillus casei
  MISC_FEATURE: ATCC 334
MKLIDQSQSPLNILEQVGQDHDGPIKGYVHSVESFGSVDGPGIRFVVFMQGCRMRCQYCHNPDTWNIGVGEEMTADQILADAQRYKAFWGDQGGITCSGGESLVQIDFILELFTKAKALGISTCLDTSGGPFTRDQPWFGQFEKLMAVTDISLVDIKHIDSAEHKKLTGFPNENILDMVQYMSAHGDDMWIRHVLVPERTDFDPYLKRLGDYIATLDKNVVQKVEILPYHTLGVKKYHELGITYPLEGIEPPSADRVKNAENLLHVKDYTGWQSWRPKPVASN

SEQ ID NO: 39 - DNA, 879 bp, Bifidobacterium adolescentis
atgtctgaacatattttccgttccacgaccagacacatgctgagggattccaaggactacgtcaatcagacgctgatgggaggcctgtccggattcgaatcgccaatcggcttggaccgtctcgaccgcatcaaggcgttgaaaagcggcgatatcggtttcgtgcactcgtgggacatcaacacttccgtggatggtcctggcaccagaatgaccgtgttcatgagcggatgccctctgcgctgccagtactgccagaatccggatacttggaagatgcgcgacggcaagcccgtctactacgaagccatggtcaagaaaatcgagcggtatgccgatttattcaaggccaccggcggcggcatcactttctccggcggcgaatccatgatgcagccggctttcgtgtcacgcgtgttccatgccgccaagcagatgggagtgcatacctgcctcgacacgtccggattcctcggggcgagctacaccgatgacatggtggatgacatcgacctgtgcctgcttgacgtcaaatccggcgatgaggagacctaccataaggtgaccggcggcatcctgcagccgaccatcgacttcggacagcgtctggccaaggcaggcaagaagatctgggtgcgtttcgtgctcgtgccgggcctcacatcctccgaagaaaacgtcgagaacgtggcgaagatctgcgagaccttcggcgacgcgttggaacatatcgacgtattgcccttccaccagcttggccgtccgaagtggcacatgctgaacatcccatacccgttggaggaccagaaaggcccgtccgcggcaatgaaacaacgtgtggtcgagcagttccagtcgcacggcttcaccgtgtactaa

SEQ ID NO: 40 - protein, 292 aa, Bifidobacterium adolescentis
MSEHIFRSTTRHMLRDSKDYVNQTLMGGLSGFESPIGLDRLDRIKALKSGDIGFVHSWDINTSVDGPGTRMTVFMSGCPLRCQYCQNPDTWKMRDGKPVYYEAMVKKIERYADLFKATGGGITFSGGESMMQPAFVSRVFHAAKQMGVHTCLDTSGFLGASYTDDMVDDIDLCLLDVKSGDEETYHKVTGGILQPTIDFGQRLAKAGKKIWVRFVLVPGLTSSEENVENVAKICETFGDALEHIDVLPFHQLGRPKWHMLNIPYPLEDQKGPSAAMKQRVVEQFQSHGFTVY

SEQ ID NO: 41 - DNA, 882 bp, Bifidobacterium longum
  misc_feature: NCC2705
atgcccgcaacacccacgttccgcaccacgaccaggcatatgctcaaggaatcgaagacctatgcctcgcagactttgatgggcggcctttccggctttgaatccccaatcggactcgaccgacgtgaccgcctttccgccctgaaatccggcgatatcggcttcgtccactcttgggacatcaacacctccgtggacggaccgggcacccgtatgaccgtgttcatgtccggctgcccgctgcgctgccagtactgccagaacccggacacttggaagatgcgcgacggcaagcccgtctaccttgacgccatgatcaagaaggtcgatcgttacaaggacctgttcaaggccacgcatggcggtatcaccttctccggcggcgaatccatgatgcagcccgccttcgtctcgcgtgtgttccatgccgccaaggagatgggcgtgcacacctgcctcgacacgtccggcttcctcaacacgaattacaccgacgagatgctcgaggacatcgacctgtgtctgctcgacgtcaaatccggcgacgaggagacctatcacaaggtcaccggcggcaccttgcagcccaccatcgattttggccagcgactggccaaggccggcaagaagatctgggtgcgatttgtgctcgtgccgggcctgaccgactccgaagagaacgtcgaaaacgtggcgaagatctgcgagtccttcggcgatgccgtcgaacacatcgacgtgctgggattccaccagcttggccgcccgaagtggcacgaactgcgcatcccatacccgctggagaaccagaagggacccaacgccgccacccgcgaacgggtggccaaccagttcaaggaccacggcttcaccgtgtattaa

SEQ ID NO: 42 - protein, 293 aa, Bifidobacterium longum
  MISC_FEATURE: NCC2705
MPATPTFRTTTRHMLKESKTYASQTLMGGLSGFESPIGLDRRDRLSALKSGDIGFVHSWDINTSVDGPGTRMTVFMSGCPLRCQYCQNPDTWKMRDGKPVYLDAMIKKVDRYKDLFKATHGGITFSGGESMMQPAFVSRVFHAAKEMGVHTCLDTSGFLNTNYTDEMLEDIDLCLLDVKSGDEETYHKVTGGTLQPTIDFGQRLAKAGKKIWVRFVLVPGLTDSEENVENVAKICESFGDAVEHIDVLGFHQLGRPKWHELRIPYPLENQKGPNAATRERVANQFKDHGFTVY

SEQ ID NO: 43 - DNA, 882 bp, Bifidobacterium longum
  misc_feature: DJO10A
atgcccgcaacacccacgttccgcaccacgaccaggcatatgctcaaggaatcgaagacctatgcctcgcagactttgatgggtggcctttccggctttgaatccccaatcggactcgaccgacgtgaccgcctttccgccctgaaatccggtgatatcggcttcgtccactcttgggacatcaacacctccgtggatggaccgggcacccgcatgaccgtgttcatgtccggctgcccgctgcgctgccagtactgccagaacccggacacttggaagatgcgcgacggcaagcccgtctaccttgacgccatgatcaagaaggtcgatcgttacaaggacctgttcaaggccacgcatggcggtatcaccttctccggcggcgaatccatgatgcagcccgccttcgtctcgcgtgtgttccatgccgccaaggagatgggcgtgcacacctgcctcgatacgtccggcttcctcaacacgaattacaccgacgagatgctcgaggacatcgacctgtgtctgctcgacgtcaaatccggcgacgaggagacctatcacaaggtcaccggcggcaccttgcagcccaccatcgattttggccagcgactggccaaggccggcaagaagatctgggtgcgatttgtgctcgtgccgggcctgaccgactccgaagagaacgtcgaaaacgtggcgaagatctgcgagtccttcggtgatgccgtcgaacacatcgacgtgctgggattccaccagcttggccgcccgaagtggcacgaactgcgtatcccatacccgctggagaaccagaagggacccaacgccgccacccgcgaacgggtgaccaaccagttcaaggaccacggcttcaccgtgtattaa

SEQ ID NO: 44 - protein, 293 aa, Bifidobacterium longum
  MISC_FEATURE: DJO10A
MPATPTFRTTTRHMLKESKTYASQTLMGGLSGFESPIGLDRRDRLSALKSGDIGFVHSWDINTSVDGPGTRMTVFMSGCPLRCQYCQNPDTWKMRDGKPVYLDAMIKKVDRYKDLFKATHGGITFSGGESMMQPAFVSRVFHAAKEMGVHTCLDTSGFLNTNYTDEMLEDIDLCLLDVKSGDEETYHKVTGGTLQPTIDFGQRLAKAGKKIWVRFVLVPGLTDSEENVENVAKICESFGDAVEHIDVLGFHQLGRPKWHELRIPYPLENQKGPNAATRERVTNQFKDHGFTVY

SEQ ID NO: 45 - DNA, 903 bp, Bifidobacterium animalis
  misc_feature: DSM 10140
atgtcgaattcagagtcgaatcacggtgcatccgcattccgcaccacgacgcggcacatgctcaagtcgtcgaaggagtaccagcgcaagacgctcatgggcggtctgtcaggattcgaatcgcccatcggactcgatcggcgtgaccgcatcaatgcgttgaaaaccggcgacataggttttgtgcattcctgggacatcaatacgtcggtggacggcccgggcacccgcatgacggtattcctgagcggctgcccactgcgctgccagtactgccagaaccccgacacctggaagatgcgcgacggcaagccggtgtacctcgatgccatggtggtcaagatcgaacggtacaaggacctgttcgaagccacgaaaggcggcatcaccttctcgggcggcgagtccatgatgcagccggcattcgtgtcgcgggtgttccgggcggccaaggagatgggtgtgcacacctgccttgatacttcgggcttcctcaacgccaactattcggatgaaatgatcgacgacatcgatctgtgcctgctcgatgtgaagtccggagacgaggagacctacaagcgggtaaccgggggagtgctccagcccaccatcgatttcggacagcggttgaacaggaggggcaagaagatctgggtgcgcttcgtgctggttcccgggctcacctcgtcggaggagaacgtggagaatgtggcccgcatctgtgagagcttcggcgacgcggtggagcatatagacgtgctgccgttccaccagctcgggcgtccgaagtggcatgagctgcgaatcccttacccgttggaggaccagaagggaccttcccaggcgttgcgcgaccgcgtgcgccagcagttcgagagccacggattcacggtctacgtctaa

SEQ ID NO: 46 - protein, 300 aa, Bifidobacterium animalis
  MISC_FEATURE: DSM 10140
MSNSESNHGASAFRTTTRHMLKSSKEYQRKTLMGGLSGFESPIGLDRRDRINALKTGDIGFVHSWDINTSVDGPGTRMTVFLSGCPLRCQYCQNPDTWKMRDGKPVYLDAMVVKIERYKDLFEATKGGITFSGGESMMQPAFVSRVFRAAKEMGVHTCLDTSGFLNANYSDEMIDDIDLCLLDVKSGDEETYKRVTGGVLQPTIDFGQRLNRRGKKIWVRFVLVPGLTSSEENVENVARICESFGDAVEHIDVLPFHQLGRPKWHELRIPYPLEDQKGPSQALRDRVRQQFESHGFTVYV

SEQ ID NO: 47 - DNA, 720 bp, Clostridium cellulolyticum
atggagattaaagggaggatacattcatttgagacatttgggaccgtggacggtcccggaattagatttattgtgtttctgaagggctgcccgcttcgctgtaagtactgccacaacagagatgcatggagttcagagggtgcaaaactgtacagtcctcaagaggtgttgaaggaaatccagaaatacaggaattttatagatgcctctcatggaggaataacagtcagcgggggagaacctttaattcagcatgaatttgtaaaggaactatttaaattatgtcgtgaagctgggatacataccgctgtggacacttccggctacgtcaatgtggaagatgtaaaggacacactagagtatacagaccttgttcttcttgatttaaagcaggcaaatgcacagaagcatttggaattgacaggagtggagaataagcgtatcaagctgtttacaacctacctgggtgaaatcggaaaacctgtttggataagatatgtgcttataccgggttatacagatggtgaagaggatttgctggcagcatacaattatttaaagggatttaaaaatatagagaaaatagaggttcttccatatcacataatgggaaaggcaaaatgggagaagctgaacgtacaatatcccctggagggagttccttcccctacacaggaagaggtggacagggccaaaaacatcctgactacaggaaaaccg

SEQ ID NO: 48 - protein, 240 aa, Clostridium cellulolyticum
MEIKGRIHSFETFGTVDGPGIRFIVFLKGCPLRCKYCHNRDAWSSEGAKLYSPQEVLKEIQKYRNFIDASHGGITVSGGEPLIQHEFVKELFKLCREAGIHTAVDTSGYVNVEDVKDTLEYTDLVLLDLKQANAQKHLELTGVENKRIKLFTTYLGEIGKPVWIRYVLIPGYTDGEEDLLAAYNYLKGFKNIEKIEVLPYHIMGKAKWEKLNVQYPLEGVPSPTQEEVDRAKNILTTGKP

SEQ ID NO: 49 - DNA, 741 bp, Escherichia coli
atgtcagttattggtcgcattcactcctttgaatcctgtggaaccgtagacggcccaggtattcgctttatcacctttttccagggctgcctgatgcgctgcctgtattgtcataaccgcgacacctgggacacgcatggcggtaaagaagttaccgttgaagatttgatgaaggaagtggtgacctatcgccactttatgaacgcttccggcggcggcgttaccgcatccggcggtgaagcaatcctgcaagctgagtttgttcgtgactggttccgcgcctgcaaaaaagaaggcattcatacctgtctggacaccaacggttttgttcgtcgttacgatccggtgattgatgaactgctggaagtaaccgacctggtaatgctcgatctcaaacagatgaacgacgagatccaccaaaatctggttggagtttccaaccaccgcacgctggagttcgctaaatatctggcgaacaaaaatgtgaaggtgtggatccgctacgttgttgtcccaggctggtctgacgatgacgattcagcgcatcgcctcggtgaatttacccgtgatatgggcaacgttgagaaaatcgagcttctcccctaccacgagctgggcaaacacaaatgggtggcaatgggtgaagagtacaaactcgacggtgttaaaccaccgaagaaagagaccatggaacgcgtgaaaggcattcttgagcagtacggtcataaggtaatgttctaa

SEQ ID NO: 50 - protein, 246 aa, Escherichia coli
MSVIGRIHSFESCGTVDGPGIRFITFFQGCLMRCLYCHNRDTWDTHGGKEVTVEDLMKEVVTYRHFMNASGGGVTASGGEAILQAEFVRDWFRACKKEGIHTCLDTNGFVRRYDPVIDELLEVTDLVMLDLKQMNDEIHQNLVGVSNHRTLEFAKYLANKNVKVWIRYVVVPGWSDDDDSAHRLGEFTRDMGNVEKIELLPYHELGKHKWVAMGEEYKLDGVKPPKKETMERVKGILEQYGHKVMF

SEQ ID NO: 51 - DNA, 2226 bp, Bacillus licheniformis
  misc_feature: DSM13
atggaacaatggaaaggtttcaccacaaacgtttggcaaaaagaagtcaatgtccgcgattttattctctcgaactttgagccatatcaaggtgacgaatcgtttctcgaacctccgacggaagctacatcggcattatgggatcatgtaatggatttgacaaaaaaagagcgtgaaaacggaggcgtccttgatatggatacagagatcgtctcaacgatcacctcgcacggtcccggatatttgaacaaagacctggaaaaagtcgtcggcgttcaaaccgatgagccgtttaaacggtcgcttcagcctttcggcggcatccgaatggcaaagcaggcatgcgaatcctatggttttaaactgaatgaagaagtggaaaggatctttaccgattaccgcaaaactcataaccaaggcgtgtttgacgcatatacggacgaaatgaagctcgcccgaaaagtcggaatcattaccggactgcctgatgcttacgggcgcgggcgcatcatcggtgattaccggagagtggcgctttacggcgtggatttcttgatcgatgaaaagaaaaaagatgcggccggcacctctcgggtgatgtctgaagaaaacatccgccttcgtgaagaactgtcagaacaaatccgagcattgaacgaacttaaagcgcttgcaaaaagctatgggtttgacatttccaagcctgcggcgaatgcaagagaagcatttcaatggctgtattttgcctatttggctgccattaaagagcaaaacggagcagcaatgagccttggccgcgtgtccacgttccttgatatttacatcgaaagagatttgaaaacgggcgtattaacagagcgtgaagcccaagagcttgtcgaccatttcgtcatgaagctgcgtttggtcaaattcgcgcgcacacctgactacaatgaactgttcagcggcgatccgacgtgggtgacagaatcaatcggcggaatggcgcacgacggacgcgccctggtgacgaaaaactcgttccgtttcctgcatacgcttgacaatttaggcccggcgcctgaaccgaatttaaccgttctttggtctgtcagactgccgcaaaagtttaaaaactactgtgccaaaatgtcgattaaaacaagctcgatccaatacgaaaatgacgatatcatgcgtccagaatacggtgatgactacggaatcgcctgctgtgtatcggcaatggcaatcggcaaacaaatgcagttcttcggagcacgcgccaacttggcgaaagctcttttatatgcgattaacggcggaaaagacgaaaagcataaaatgcaagtcggtccggaaatgccgccggttgcttccgacgtgctggactatgacgaagtgatgcataaattcgatcagacgatggaatggctcgcaggcttgtacatcaacacgctcaatgtcattcactacatgcatgataaatattgctatgaaagaattgaaatggccctgcacgacacggaaattttgcggacgatggccactgggatcgccggcttgagtgttgtcgccgattcattaagcgctgtcaaatatgccaaagtcagcgtggtccgcgatgaaaacggcattgcggtcgattttgaaacagaaggcgactttcctaagtacggaaataacgatgaccgcgtcgacgcgatcgccgttgacattgtcaagcgctttatgaaaaaactgcgcaagcatcagacatatcgccagtccgttcagaccatgtcaattttaacgatcacgtcaaacgtcgtttacggcaagaaaaccggaaatacgccggatggacgccgcgcgggagaaccgtttgctccaggtgcgaatccgatgcacggccgcgatactaaagggacgcttgcatcgctgtcttcagtggcaaagctgccttacagctatgcgctcgacggcatttccaacaccttttcaatcgtcccgaaagcgcttggcaaagacgaagagagccgcgccgccaatttgtcaagcatccttgacggatatgccgcaaaaacaggacatcacttaaatgtaaacgtatttaacagagagacactgctcgacgccatggaacatccagaggaatatccgcagttaacgattcgcgtctcaggctatgcggtcaactttattaagctgacgaaagaacagcagttagacgtcatcagcagaaccttccatgaatcgatgtag

SEQ ID NO: 52 - protein, 741 aa, Bacillus licheniformis
  MISC_FEATURE: DSM13
MEQWKGFTTNVWQKEVNVRDFILSNFEPYQGDESFLEPPTEATSALWDHVMDLTKKERENGGVLDMDTEIVSTITSHGPGYLNKDLEKVVGVQTDEPFKRSLQPFGGIRMAKQACESYGFKLNEEVERIFTDYRKTHNQGVFDAYTDEMKLARKVGIITGLPDAYGRGRIIGDYRRVALYGVDFLIDEKKKDAAGTSRVMSEENIRLREELSEQIRALNELKALAKSYGFDISKPAANAREAFQWLYFAYLAAIKEQNGAAMSLGRVSTFLDIYIERDLKTGVLTEREAQELVDHFVMKLRLVKFARTPDYNELFSGDPTWVTESIGGMAHDGRALVTKNSFRFLHTLDNLGPAPEPNLTVLWSVRLPQKFKNYCAKMSIKTSSIQYENDDIMRPEYGDDYGIACCVSAMAIGKQMQFFGARANLAKALLYAINGGKDEKHKMQVGPEMPPVASDVLDYDEVMHKFDQTMEWLAGLYINTLNVIHYMHDKYCYERIEMALHDTEILRTMATGIAGLSVVADSLSAVKYAKVSVVRDENGIAVDFETEGDFPKYGNNDDRVDAIAVDIVKRFMKKLRKHQTYRQSVQTMSILTITSNVVYGKKTGNTPDGRRAGEPFAPGANPMHGRDTKGTLASLSSVAKLPYSYALDGISNTFSIVPKALGKDEESRAANLSSILDGYAAKTGHHLNVNVFNRETLLDAMEHPEEYPQLTIRVSGYAVNFIKLTKEQQLDVISRTFHESM

SEQ ID NO: 53 - DNA, 2226 bp, Bacillus licheniformis; identical to SEQ ID NO: 51
  misc_feature: ATCC14580

SEQ ID NO: 54 - protein, 741 aa, Bacillus licheniformis; identical to SEQ ID NO: 52
  MISC_FEATURE: ATCC14580

SEQ ID NO: 55 - DNA, 2310 bp, Streptococcus thermophilus
  misc_feature: CNRZ1066
atggcaacggttaaaactaacacagatgtttttgaaaaagcgtgggaaggctttaaaggaactgactggaaagaaaaagcaagtgtgtctcgcttcgtacaagcaaactacacaccatatgatggtgatgaaagcttccttgcaggaccaactgaacgctcacttaaaatcaaaaaaatcattgaagaaactaaagcccactacgaagaaactcgtttcccaatggatactcgtccgacatcaatcgcagatattcctgccggctatatttcaaaagacgacgaactaatctacggtattcaaaatgatgagttattcaaattgaatttcatgccaaaaggcggaattcgtatggcagaaacagctctcaaggaacatggctatgaacctgatccagctgttcacgaaatttttacaaaacatgtaactacagtaaatgacggtatcttccgtgcttatacatcaaatatccgtcgtgcacgtcacgcacacactataactggacttccagatgcttactctcgtggacgtatcatcggtgtttatgctcgccttgctctttacggtgctgacttcttgatgcaagaaaaagtaaacgactggaactctatcgaagaaatcaacgaagaaactattcgtcttcgtgaagaagttaaccttcaataccaagcacttcaagatgttgttcgccttggtgacctttacggtgtagatgttcgtcgtccagccttcgatactaaagaagctatccaatggacaaacattgcttttatggctgtatgtcgtgttatcaatggtgcggctacttcacttggtcgtgtgccaatcgtccttgacatatatgcagaacgtgaccttgctcgtggtacttacactgaatcagaaatccaagaattcgttgatgattttgtcttgaaacttcgtactgtaaaattcgcacgtacaaaagcttacgacgaactttactcaggtgacccaacattcatcacaacttctatggctggtatgggtgctgacggacgtcaccgtgttactaaaatggactaccgtttcttgaacacacttgataatattggtaatgctccagaaccaaacttgacagttctttggtctgacaaattgccttactcattccgtcgctactgtatgcacatgagtcacaagcactcttctattcaatacgaaggtgtgactactatggctaaagacggatacggtgaaatgagctgtatctcatgttgtgtatcaccacttgacccagaaaacgaagaacaacgccacaacatccaatacttcggtgctcgtgttaacgtacttaaagcccttcttactggtttgaacggtggttacgacgatgttcataaagactacaaagtatttgacatcgatccagtccgtgatgaagttcttgactttgacactgttaaagctaacttcgaaaaatctcttgactggttgactgacacttatgtagatgcccttaacatcatccactacatgactgataagtacaactacgaagctgttcaaatggccttcttgccaactaaacaacgtgctaacatgggattcggtatctgtggtttcgcaaatactgttgatacattgtcagctatcaagtacgctacagttaaaccaatccgtgacgaagatggctacatctacgactacgaaacaatcggtgaatacccacgttggggtgaagatgacccacgttcaaacgaattggcagaatggttgattgaagcttacactactcgtcttcgtagccataaactctacaaagatgcagaagctacagtttcacttcttacaatcacttcgaacgttgcttactctaaacaaactggtaactctccagttcacaaaggggtatacctcaacgaagatggttcagtgaacttgtccaaattggaattcttctcaccaggtgctaacccatctaacaaagctaaaggtggatggttgcaaaacttgaactcacttgcaagccttgacttcggttatgcagctgacggtatctcacttactactcaagtatcacctcgtgcccttggtaagactcgcgacgaacaagttgataacctcgtaactatccttgacggatacttcgaaaacggtggacaacaccttaacttgaacgttatggacttgtcagctgtttacaaaaagatcatgagcggtgaagatgttatcgtacgtatctctggatactgtgtaaacactaaatacctcactccagaacaaaaaactgaattgacacaacgtgtcttccacgaagttctttcaacggacgatgctatgggataa

SEQ ID NO: 56 - protein, 769 aa, Streptococcus thermophilus
  MISC_FEATURE: CNRZ1066
MATVKTNTDVFEKAWEGFKGTDWKEKASVSRFVQANYTPYDGDESFLAGPTERSLKIKKIIEETKAHYEETRFPMDTRPTSIADIPAGYISKDDELIYGIQNDELFKLNFMPKGGIRMAETALKEHGYEPDPAVHEIFTKHVTTVNDGIFRAYTSNIRRARHAHTITGLPDAYSRGRIIGVYARLALYGADFLMQEKVNDWNSIEEINEETIRLREEVNLQYQALQDVVRLGDLYGVDVRRPAFDTKEAIQWTNIAFMAVCRVINGAATSLGRVPIVLDIYAERDLARGTYTESEIQEFVDDFVLKLRTVKFARTKAYDELYSGDPTFITTSMAGMGADGRHRVTKMDYRFLNTLDNIGNAPEPNLTVLWSDKLPYSFRRYCMHMSHKHSSIQYEGVTTMAKDGYGEMSCISCCVSPLDPENEEQRHNIQYFGARVNVLKALLTGLNGGYDDVHKDYKVFDIDPVRDEVLDFDTVKANFEKSLDWLTDTYVDALNIIHYMTDKYNYEAVQMAFLPTKQRANMGFGICGFANTVDTLSAIKYATVKPIRDEDGYIYDYETIGEYPRWGEDDPRSNELAEWLIEAYTTRLRSHKLYKDAEATVSLLTITSNVAYSKQTGNSPVHKGVYLNEDGSVNLSKLEFFSPGANPSNKAKGGWLQNLNSLASLDFGYAADGISLTTQVSPRALGKTRDEQVDNLVTILDGYFENGGQHLNLNVMDLSAVYKKIMSGEDVIVRISGYCVNTKYLTPEQKTELTQRVFHEVLSTDDAMG

SEQ ID NO: 57 - DNA, 2310 bp, Streptococcus thermophilus
  MISC_FEATURE: LMG18311
atggcaacggttaaaactaacacagatgtttttgaaaaagcgtgggaaggctttaaaggaactgactggaaagaaaaagcaagtgtgtctcgcttcgtacaagcaaactacacaccatatgatggtgatgaaagcttccttgcaggaccaactgaacgctcacttaaaatcaaaaaaatcattgaagaaactaaagctcactacgaagaaactcgtttcccaatggatactcgtccgacatcaatcgcagatattcctgccggctatatttcaaaagacgacgaactaatctacggtattcaaaatgatgagttattcaaattgaatttcatgccaaaaggcggaattcgtatggcagaaacagctctcaaggaacatggctatgaacctgatccagctgttcacgaaatttttacaaaacatgtaactacagtaaatgacggtatcttccgtgcttatacatcaaatatccgtcgtgcacgtcacgcacacactataactggacttccagatgcttactctcgtggacgtatcatcggtgtttatgctcgccttgctctttacggtgctgacttcttgatgcaagaaaaagtaaacgactggaactctatcgaagaaatcaacgaagaaactattcgtcttcgtgaagaagttaaccttcaataccaagcacttcaagatgttgttcgccttggtgacctttacggtgtagatgttcgtcgtccagccttcgatactaaagaagctatccaatggacaaacattgcttttatggctgtatgtcgtgttatcaatggtgcggctacttcacttggtcgtgtgccaatcgtccttgacatatatgcagaacgtgaccttgctcgtggtacttacactgaatcagaaatccaagaattcgttgatgattttgtcttgaaacttcgtactgtaaaattcgcacgtacaaaagcttacgacgaactttactcaggtgacccaacattcatcacaacttctatggctggtatgggtgctgacggacgtcaccgtgttactaaaatggactaccgtttcttgaacacacttgataatattggtaatgctccagaaccaaacttgacagttctttggtctgacaaattgccttactcattccgtcgctactgtatgcacatgagtcacaagcactcttctattcaatacgaaggtgtgactactatggctaaagacggatacggtgaaatgagctgtatctcatgttgtgtatcaccacttgacccagaaaacgaagaacaacgccacaacatccaatacttcggtgctcgtgttaacgtacttaaagcccttcttactggtttgaacggtggttacgacgatgttcataaagactacaaagtatttgacatcgatccagtccgtgatgaagttcttgactttgacactgttaaagctaacttcgaaaaatctcttgactggttgactgacacttatgtagatgcccttaacatcatccactacatgactgataagtacaactacgaagctgttcaaatggccttcttgccaactaaacaacgtgctaacatgggattcggtatctgtggtttcgcaaatactgttgatacattgtcagctatcaagtacgctacagttaaaccaatccgtgacgaagatggctacatctacgactacgaaacaatcggtgaatacccacgttggggtgaagatgacccacgttcaaacgaattggcagaatggttgattgaagcttacactactcgtcttcgtagccataaactctacaaagatgcagaagctacagtttcacttcttacaatcacttcgaacgttgcttactctaaacaaactggtaactctccagttcacaaaggggtatacctcaacgaagatggttcagtgaacttgtctaaattggaattcttctcaccaggtgctaacccatctaacaaagctaaaggtggatggttgcaaaacttgaactcacttgcaagccttgacttcggttatgcagctgacggtatctcacttactactcaagtatcacctcgtgcccttggtaagactcgcgacgaacaagttgataacctcgtaactatccttgacggatacttcgaaaacggtggacaacaccttaacttgaacgttatggacttgtcagctgtttacaaaaagatcatgagcggtgaagatgttatcgtacgtatctctggatactgtgtaaacactaaatacctcactccagaacaaaaaactgaattgacacaacgtgtcttccacgaagttctttcaacggacgatgctatgggataa

SEQ ID NO: 58 - protein, 769 aa, Streptococcus thermophilus; identical to SEQ ID NO: 56
  MISC_FEATURE: LMG18311

SEQ ID NO: 59 - DNA, 2310 bp, Streptococcus thermophilus
  misc_feature: LMD-9
atggcaacggttaaaactaacacagatgtttttgaaaaagcgtgggaaggctttaaaggaactgactggaaagaaaaagcaagtgtgtctcgcttcgtacaagcaaactacacaccatatgatggtgatgaaagcttccttgcaggaccaactgaacgctcacttaaaatcaaaaaaatcattgaagaaactaaagctcactacgaagaaactcgtttcccaatggatactcgtccgacatcaatcgcagatattcctgccggctatatttcaaaagacgacgaactaatctacggtattcaaaatgatgagttattcaaattgaatttcatgccaaaaggcggaattcgtatggcagaaacagctctcaaggaacatggctatgaacctgatccagctgttcacgaaatttttacaaaacatgtaactacagtaaatgacggtatcttccgtgcttatacatcaaatatccgtcgtgcacgtcacgcacacactataactggacttccagatgcttactctcgtggacgtatcatcggtgtttatgctcgccttgctctttacggtgctgacttcttgatgcaagaaaaagtaaacgactggaactctatcgaagaaatcaacgaagaaactattcgtcttcgtgaagaagttaaccttcaataccaagcacttcaagatgttgttcgccttggtgacctttacggtgtagatgttcgtcgtccagccttcgatactaaagaagctatccaatggacaaacattgcttttatggctgtatgtcgtgttatcaatggtgcggctacttcacttggtcgtgtgccaatcgtccttgacatatatgcagaacgtgaccttgctcgtggtacttacactgaatcagaaatccaagaattcgttgatgattttgtcttgaaacttcgtactgtaaaattcgcacgtacaaaagcttacgacgaactttactcaggtgacccaacattcatcacaacttctatggctggtatgggtgctgacggacgtcaccgtgttactaaaatggactaccgtttcttgaacacacttgataatattggtaatgctccagaaccaaacttgacagttctttggtctgacaaattgccttactcattccgtcgctactgtatgcacatgagtcacaagcactcttctattcaatacgaaggtgtgactactatggctaaagacggatacggtgaaatgagctgtatctcatgttgtgtatcaccacttgacccagaaaacgaagaacaacgccacaacatccaatacttcggtgctcgtgttaacgtacttaaagcccttcttactggtttgaacggtggttacgacgatgttcataaagactacaaagtatttgacatcgatccagtccgtgatgaagttcttgactttgacactgttaaagctaacttcgaaaaatctcttgactggttgactgacacttatgtagatgcccttaacatcatccactacatgactgataagtacaactacgaagctgttcaaatggccttcttgccaactaaacaacgtgctaacatgggattcggtatctgtggtttcgcaaatactgttgatacattgtcagctatcaagtacgctacagttaaaccaatccgtgacgaagatggctacatctacgactacgaaacaatcggtgaatacccacgttggggtgaagatgacccacgttcaaacgaattggcagaatggttgattgaagcttacactactcgtcttcgtagccataaactctacaaagatgcagaagctacagtttcacttcttacaatcacttcgaacgttgcttactctaaacaaactggtaactctccagttcacaaaggggtatacctcaacgaagatggttcagtgaacttgtctaaattggaattcttctcaccaggtgctaacccatctaacaaagctaaaggtggatggttgcaaaacttgaactcacttgcaagccttgacttcggttatgcagctgacggtatctcgcttactactcaagtatcacctcgtgcccttggtaagactcgcgacgaacaagttgataacctcgtaactatccttgacggatacttcgaaaacggtggacaacaccttaacttgaacgttatggacttgtcagctgtttacaaaaagatcatgagcggtgaagatgttatcgtacgtatctctggatactgtgtaaacactaaatacctcactccagaacaaaaaactgaattgacacaacgtgtcttccacgaagttctttcaacggacgatgctatgggataa

SEQ ID NO: 60 - protein, 769 aa, Streptococcus thermophilus; identical to SEQ ID NO: 56
  MISC_FEATURE: LMD-9

SEQ ID NO: 61 - DNA, 2445 bp, Lactobacillus plantarum
  misc_feature: WCFS1
atgatcatgtctgaaactttaactaaaacaacgacaactattaaccacttcggtaaattgacgccaatgatggatcgcttacgcgatagcatcattgatgcaaaaccttatgtcgatccagaacgggcgattctcacaaccgaaacttatcgacaacaccaagacgaacaagtcgatatattacgggctaaaatgcttgaacacgttcttgataaaatgagtatcttcattgaagatgatactttaattgttggtaaccaagcacgccaaaatcgttgggcaccagtattccctgagtattctatgaattgggtcattgatgaattagatacatttgagaagcgtcctggtgacgttttctatattacggagaaatccaaggaagaacttcgtgcgattgcgcctttctggaaacataataccttggaagaccgcggctacgctagttttccagaagcaagtcgtattttttatgatttaggtattattggagccgatggtaatatcacttctggtgatggtcacattgcggtcgactataaaaacgttgttaataagggacttaaatggtatgaagaccgcattaagacagcacttgctaatcttgaccttactgattttaaccagcaaaaacaatactatttctataaagcgggcctaattgtaattgatgccattcacaattttgctaaacgttacgcccaattagcgtccaagcaagctcaaaacacgacatccgcaactcgcaaagcacaacttgaaaaaatcgcccaaattctaaacaaggttccttacgaacctgcaaattcattttatgaagcgattcaagctgtctggttagttcatctgaccttacaaatcgaatccaacggtcattctgtctcatatggtcgtctagatcagtacctagctccattctatgagcacgatttaaaaactggtgctattgacgccaacggtgcaaccgaattactcacaaacttatgtcttaagacgttaacgattaataaagtacgctcatggcaacatactgaattttctgcagggagtcccctctaccaaaacattacgattggtggtcaaacaccagatggtaaagatgccgttaatccgacgtcctatctgattttacgagcaattgcgcaagcacatttaccacaacccaacttaacggtccgttatcaccatggcttaagcgataagtttatgcgtgaatgtgtcgaagttattaaacaaggcttaggtatgcctgcgtttaataacgacgaaattattattccgtcgtttattcgtcgtggcgtcaagaaagaagacgcctataattacagtgccatcggttgtgtcgaaacagcgatccctggaaaatggggctatcgttgcaccgggatgagcttcattaacttcccacgcgttctcttactcattatgaatggtggcattgatcctgaatctggcaaacggttattacccgattatggtaagttcactgatatgacttcttttgatcaacttatgactgcttgggacaaagcgctccgtgaaatgacacgacaaagtgtgattatcgaaaatagttgtgatttggctttggaacaaaattatcctgatattctctgctccgttttaaccgacgattgtatcggtcgtggtaagaccattaaagaaggtggcgcggtatacgactttatcagtggattacaagttggtattgctaacctagcggactccctagctgcaatcaagaaacttgtctttgaagaaaagaagttgacaacaacccaactttggcacgcacttaccactgattttgcggatgaagatggtgaaaagattcggcagatgctcattaatgatgccccaaagtatggtaacgatgatgattatgttgatgatttgattgttgaagcttataaaccatatattgatgaaattgccaagtacaaaaacacgcgctacggtcgcggccctattggtggcttgcgctacgcaggaacctcttctatttcggccaacgttggtcaagggcacagcactttggctacaccagatggtcggcacgctcggacaccattagccgaaggttgctcaccagaacatgcaatggatactgatggcccaactgctgtgttcaaatcagtttccaaattatccactaaggacatcactggtggcgtattactgaaccaaaagatgtcaccacaaattctacggagtgatgaaagctgcatgaaattggttgcactactacggaccttcttcaatcgacttcatggttaccatgtccaatacaacattgtttcacgggataccttgattgatgcacagaaccatcctgacaagcaccgtgacttgattgttcgggttgctggatattccgccttcttcgtgggcctatccaaagaaacccaagatgatattatcgaacggacggagcagtctctataa

SEQ ID NO: 62 - protein, 814 aa, Lactobacillus plantarum
  MISC_FEATURE: WCFS1
MIMSETLTKTTTTINHFGKLTPMMDRLRDSIIDAKPYVDPERAILTTETYRQHQDEQVDILRAKMLEHVLDKMSIFIEDDTLIVGNQARQNRWAPVFPEYSMNWVIDELDTFEKRPGDVFYITEKSKEELRAIAPFWKHNTLEDRGYASFPEASRIFYDLGIIGADGNITSGDGHIAVDYKNVVNKGLKWYEDRIKTALANLDLTDFNQQKQYYFYKAGLIVIDAIHNFAKRYAQLASKQAQNTTSATRKAQLEKIAQILNKVPYEPANSFYEAIQAVWLVHLTLQIESNGHSVSYGRLDQYLAPFYEHDLKTGAIDANGATELLTNLCLKTLTINKVRSWQHTEFSAGSPLYQNITIGGQTPDGKDAVNPTSYLILRAIAQAHLPQPNLTVRYHHGLSDKFMRECVEVIKQGLGMPAFNNDEIIIPSFIRRGVKKEDAYNYSAIGCVETAIPGKWGYRCTGMSFINFPRVLLLIMNGGIDPESGKRLLPDYGKFTDMTSFDQLMTAWDKALREMTRQSVIIENSCDLALEQNYPDILCSVLTDDCIGRGKTIKEGGAVYDFISGLQVGIANLADSLAAIKKLVFEEKKLTTTQLWHALTTDFADEDGEKIRQMLINDAPKYGNDDDYVDDLIVEAYKPYIDEIAKYKNTRYGRGPIGGLRYAGTSSISANVGQGHSTLATPDGRHARTPLAEGCSPEHAMDTDGPTAVFKSVSKLSTKDITGGVLLNQKMSPQILRSDESCMKLVALLRTFFNRLHGYHVQYNIVSRDTLIDAQNHPDKHRDLIVRVAGYSAFFVGLSKETQDDIIERTEQSL

SEQ ID NO: 63 - DNA, 2259 bp, Lactobacillus plantarum
  misc_feature: WCFS1
atgattacatcagaaaagacaacaaaaccagcagcttggaaaggtttcaaaggcgggcactggcaggaagaaatcaacattcgtgattttattcaaaataacttcacacagtacaatggcgacgaaagcttcctggccggaccaacagccgctactaagaccttgaatgacaaagtcttagaattaaagaaacaagaacgtgccgctggtggtgtgttggatgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatacgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattctctcttctctggtgacccaatctgggcaaccttatcaatgtgtggtttaggcgtcgacggtcaacaccatgtgactaagactgctttccggattttaaagactttggacaacatgggcgccgcaccagaaccaaacatcacgattttatggtcagaccgcttaccagaagacttcaaacgttacgcaactgaagtttcaatcgacagttcaaccattcagtatgaaaatgatgacttgatgcgggtacaatggggtaccgattattatggcattgcttgctgtgtttccgcacaaccaattgctgatggaatccagtacttcggtgcccgggcaaacttagccaaagcgattctttatgccatcaatggtggccgcgacgaaattgctggagatcaagttggccctgcttacgaaccaattacttcagaatacatcgattacgacgaattcatgaagaaattagacaagcaaatggattggttagctgacacttacgttaactcactgaatgcaattcattatatgcatgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgcgctgatgacattgctaaatggttagtcaaagaattatacagcaagatgaacacgcatcacctctatcggaatgccaaactttcaacttctgttttgacgattacctccaacgttgtttatggtaagaacactggtaccacgccaaatggccgtcaaaaaggcgaaccattctcaccaggtgctaaccctgcatacggtgctgaaaagagtggtgcattagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaacgatgggatgcacttgaacatcaacgtcttcaataaagacactttgattgatgctcagaaacaccctgaagaatacccaacattaacggttcgggtttctggctattgtgtctacttcgcagatttaaccaaggaacaacaagatgacgttatttcacggacattcttcgaatcaatgtaa

SEQ ID NO: 64 - protein, 752 aa, Lactobacillus plantarum
  MISC_FEATURE: WCFS1
MITSEKTTKPAAWKGFKGGHWQEEINIRDFIQNNFTQYNGDESFLAGPTAATKTLNDKVLELKKQERAAGGVLDADTKVVATITSHGPGYIQKDLEKIVGLQTDKPLKRAFMPFGGIRMADDALKSYGYTPDEENDKIFTEYRKTHNQGVFDVYTPDMRKARHYKIITGLPDAYARGRLIPDLPRVAVYGIDRLMEDKANDFAHIGDGELTDDVIRLREEVQDQYRALADMKKMAASYGYDISKPATNAQEAIQWMYFAYLAAIKTQNGAAMSVGRIDTTMDIFIQRDLDNGVLDESQAQELIDQFVMKLRMVRFIRTEEYNSLFSGDPIWATLSMCGLGVDGQHHVTKTAFRILKTLDNMGAAPEPNITILWSDRLPEDFKRYATEVSIDSSTIQYENDDLMRVQWGTDYYGIACCVSAQPIADGIQYFGARANLAKAILYAINGGRDEIAGDQVGPAYEPITSEYIDYDEFMKKLDKQMDWLADTYVNSLNAIHYMHDKYYYEAAQLALKNTDLDRTFATGISGLSHAADSISAIKYGHVKVIRDERGIAVDFKADNDYPRYGNNDDRADDIAKWLVKELYSKMNTHHLYRNAKLSTSVLTITSNVVYGKNTGTTPNGRQKGEPFSPGANPAYGAEKSGALASLLSTAKLPYRYATDGISNTFGVTPNTLGHDLESRKDTLVNMLDGYMKNDGMHLNINVFNKDTLIDAQKHPEEYPTLTVRVSGYCVYFADLTKEQQDDVISRTFFESM

SEQ ID NO: 65 - DNA, 2259 bp, Lactobacillus plantarum
  misc_feature: JDM1
atgattacatcagaaaagacaacaaaaccagcagcttggaaaggtttcaaaggcgggcactggcaggaagaaatcaacattcgtgattttattcaaaataacttcacacagtacaatggcgacgaaagcttcctggccggaccaacagccgctactaagaccttgaatgacaaagtcttagaattaaagaaacaagaacgtgccgctggtggtgtgttggacgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatacgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattctctcttctctggtgacccaatctgggcaaccttatcaatgtgtggtttaggcgtcgacggtcaacaccatgtgactaagaccgctttccggattttaaagactttggacaacatgggcgccgcaccagaaccaaacatcacgattttatggtcagatcgcttaccagaagacttcaaacgttacgcaactgaagtttcaatcgacagttcaaccattcagtatgaaaatgatgacttgatgcgggtacaatggggtaccgattattatggcattgcttgctgtgtttccgcacaaccaattgctgatggaatccagtacttcggtgcccgggcaaacttagccaaagcgattctttatgccatcaatggtggccgcgacgaaattgctggagatcaagttggccctgcttacgaaccaattacttcagaatacatcgattacgacgaattcatgaagaaattagacaagcaaatggattggttagctgacacttacgtgaactcactgaatgcaattcattatatgcatgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgcgctgatgacattgctaaatggttagtcaaagaattatacagcaagatgaacacgcatcacctctatcggaatgccaaactttcaacttctgttttgacgattacctccaacgttgtttatggtaagaacactggtaccacaccaaatggccgtcaaaaaggcgaaccattctcaccaggtgctaaccctgcatacggtgctgaaaagagtggtgcattagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaacgatgggatgcacttgaacatcaacgtcttcaataaagacactttgattgatgctcagaaacaccctgaagaatacccaacattaacggttcgggtttctggctactgtgtctacttcgcagatttaaccaaggaacaacaagatgacgttatttcacggacattcttcgaatcaatgtaa

SEQ ID NO: 66 - protein, 752 aa, Lactobacillus plantarum; identical to SEQ ID NO: 64
  misc_feature: JDM1

SEQ ID NO: 67 - DNA, 2445 bp, Lactobacillus plantarum
  misc_feature: JDM1
atgatcatgtctgaaactttaactaaaacaacgacaactattaaccacttcggtaaattgacgccaatgatggatcgcttacgcgatagcatcattgatgcaaaaccttatgtcgatccagaacgggcgattctcacaaccgaaacttatcgacaacaccaagacgaacaagtcgatatattacgggctaaaatgcttgaacacgttcttgataaaatgagtatcttcattgaagatgatactttaattgttggtaaccaagcacgccaaaatcgttgggcaccagtattccctgagtattctatgaattgggtcattgatgaattagatacatttgagaagcgtcctggtgacgttttctatattacggagaaatctaaggaagaacttcgtgcgattgcgcctttctggaaacataataccttggaagaccgcggctacgctagttttccagaagcaagtcgtattttttatgatttaggtattattggagccgatggtaatatcacttctggtgatggtcacattgcggtcgactataaaaacgttgttaataagggacttaaatggtatgaagaccgcattaagacagcacttgctaatcttgaccttactgattttaaccagcaaaaacaatactatttctataaagcgggcctaattgtaatcgatgccattcacaattttgctaaacgttacgcccaattagcgtccaagcaagctcaaaacacgacatccgcaactcgcaaagcacaacttgaaaaaatcgcccaaattctaaacaaggttccttacgaacctgcaaattcattttatgaagcgattcaagctgtctggttagttcatctgaccttacaaatcgaatccaacggtcattctgtctcatatggtcgtctagatcagtacctagatccattctatgagcacgatttaaaaactggtgctattgacgccaacggtgcaaccgaattactcacaaacttatgtcttaagacgttaacgattaataaagtacgctcatggcaacatactgaattttctgcagggagtcccctctaccaaaacattacgattggtggtcaaacaccagatggtaaagatgccgttaatccgacgtcctatctgattttacgagcaattgcgcaagcacatttaccacaacccaacttaacggtccgttatcaccatggcttaagcgataagtttatgcgtgaatgtgtcgaagttattaaacaaggcttaggtatgcctgcgtttaataacgacgaaattattattccgtcgtttattcgtcgtggcgtcaagaaagaagacgcctataattacagtgccatcggttgtgtcgaaacagcgatccctggaaaatggggctatcgttgcaccgggatgagcttcattaacttcccacgcgttctcttactcattatgaatggtggcattgatcctgaatctggcaaacggttattacccgattatggtaagttcactgatatgacttcttttgatcaacttatgactgcttgggacaaagcgctccgtgaaatgacacgacaaagtgtgattatcgaaaatagttgtgatttggctttggaacaaaattatcctgatattctctgctccgttttaaccgacgattgtatcggtcgtggtaagaccattaaagaaggtggcgcggtatacgactttatcagtggattacaagttggtattgctaacctagcggactccctagctgcaatcaagaaacttgtctttgaagaaaagaagttgacaacaacccaactttggcacgcacttaccactgattttgcggatgaagacggtgaaaagattcggcagatgctcattaatgatgccccaaagtatggtaacgatgatgattatgttgatgatttgattgttgaagcttataaaccatatattgatgaaattgccaagtacaaaaacacgcgctacggtcgcggccctattggtggcttgcgttacgcaggaacctcttctatttcggccaacgttggtcaagggcacagcactttggctacaccagatggtcggcacgctcggacaccattagccgaaggttgctcaccagaacatgcaatggatactaatggcccaactgctgtgttcaaatcagtttccaagttatccactaaggacatcactggtggcgtattactgaaccaaaagatgtcaccacaaattctacggagtgatgaaagctgcatgaaattggttgcactactacgaaccttcttcaaccgacttcatggttaccatgtccaatacaacattgtttcacgggataccttgattgatgcacagaaccatcctgacaagcaccgtgacttgattgttcgggttgctggatattccgccttcttcgtgggcctatccaaagaaacccaagatgatattatcgaacggacggagcagtctctataa

SEQ ID NO: 68 - protein, 814 aa, Lactobacillus plantarum
  MISC_FEATURE: JDM1
MIMSETLTKTTTTINHFGKLTPMMDRLRDSIIDAKPYVDPERAILTTETYRQHQDEQVDILRAKMLEHVLDKMSIFIEDDTLIVGNQARQNRWAPVFPEYSMNWVIDELDTFEKRPGDVFYITEKSKEELRAIAPFWKHNTLEDRGYASFPEASRIFYDLGIIGADGNITSGDGHIAVDYKNVVNKGLKWYEDRIKTALANLDLTDFNQQKQYYFYKAGLIVIDAIHNFAKRYAQLASKQAQNTTSATRKAQLEKIAQILNKVPYEPANSFYEAIQAVWLVHLTLQIESNGHSVSYGRLDQYLDPFYEHDLKTGAIDANGATELLTNLCLKTLTINKVRSWQHTEFSAGSPLYQNITIGGQTPDGKDAVNPTSYLILRAIAQAHLPQPNLTVRYHHGLSDKFMRECVEVIKQGLGMPAFNNDEIIIPSFIRRGVKKEDAYNYSAIGCVETAIPGKWGYRCTGMSFINFPRVLLLIMNGGIDPESGKRLLPDYGKFTDMTSFDQLMTAWDKALREMTRQSVIIENSCDLALEQNYPDILCSVLTDDCIGRGKTIKEGGAVYDFISGLQVGIANLADSLAAIKKLVFEEKKLTTTQLWHALTTDFADEDGEKIRQMLINDAPKYGNDDDYVDDLIVEAYKPYIDEIAKYKNTRYGRGPIGGLRYAGTSSISANVGQGHSTLATPDGRHARTPLAEGCSPEHAMDTNGPTAVFKSVSKLSTKDITGGVLLNQKMSPQILRSDESCMKLVALLRTFFNRLHGYHVQYNIVSRDTLIDAQNHPDKHRDLIVRVAGYSAFFVGLSKETQDDIIERTEQSL

SEQ ID NO: 69 - DNA, 2262 bp, Lactobacillus casei
  misc_feature: bl23
atgaaacagcttgacgaaaccaaagttcctaattattgggaaggctttaacggcggcgactggcaagaagaaattaatgtgcgcgattttatcgagcataacctgaaccaatatgacggggacgaaagtttccttgctggccccactgaagcgacaacagtcctgaacaatcaggttctaaatttaaagaagcaagaacgtgcaaatggcggtgttttggatgctgacaacaatattccatctacgatcacctcacacggccctggttatttgaacaaagatcttgaaaagattgttggtgttcagaccgacaagccattcaaacgagcattcatgccatttggcggtattcgaatggctgaagatgcattggaatcttatggcttcaagacagatcctcaagaacacaagattttcaatgaatatcgtaagacccataaccaaggtgtctttgatgcttatacccctgatatgcgaaaggctcgccattacaagatcgtgactggcttgccagacgcatacggccgtggccggattgtttctgatttcccacggatcgctgtttacgggatcgatcgtttaatggctgagaagttcaaggattataacttgaccggcgacggcgaaatgactgacgatgtaatcaaactgcgtgaagaaatcaatgaacaatatcgtgccttaaacgacatgaagaagatggccaaggaatatggctatgacatctcgcgtccggcagctaatgcgcaagaagctgttcagtggatctactttggctatctggctgctgttaagactcaaaacggtgccgcaatgtccgttggccggatcgatacggttattgatgcttatatccaacgcgatatgcgcttaggcaaattgaacgaagaacaggcacaggaactgattgatcatttggttatgaaattgcggatggttcgtttcatccggactgaagaatataactcactgttctcaggcgatccaatctgggcaaccttgtcattggcaggaatgggcaatgatggccgtcaccacgttaccaagacggctttccgtttcctgaagactttggacaacatgggcgcagcaccagaaccaaacatcaccttgctttggagcgaacgcttgccagaaggcttcaaacgctatgcaaccgaagtatccatccaaagttcaaccattcaatatgaaaatgatgacctgatgcgcaacgaatggggtaccgattactacggtattgcttgctgtgtctcggcacaaccaattgctgatggcgttcaatactttggtgcccgtgctaacttagctaagacggttctgtatgcgatcaacggtgggaaagatgaaattcaggaagcgcaagtagggcctgaatatgcaccgatcaccagcgattacattgattacaaagaattcatgaataagttcgacaagatgatggactggctggccgacacgtatgtcaatgctttgaatgtgattcactatatgcatgacaagtattattatgaagctgcacagctggcattgaaggatacccaactgaaccggaccttcgcaaccgggatttccggcctgtcacacgcggttgattccatcagtgcaatcaagtatggtcatgtcaaggcaattcgcgatgaaaacggtgttgcagttgacttcgttgctgacaatgatgactatccacgctatggtaacaacgatgatcgcgctgatgacatcgctaagtggttggttaagaccttctataacaagatgaacacgcatcatctgtatcgcggcgcgaagttgagtaccagtgtcctgaccattacctccaacgtggtttatggtaagaatacagggacaacaccaaacggtcgtcaaaaaggcgaaccattctcaccaggtgccaacccggcatacggcgcagaaaagaacggcgcattggcatccttgatgtccaccgccaagattccgtatcattacgcaactgacggcattagtaatacgtttggggttactccgaacacactgggccacgatgatgaaactcgtaaggataccttggttcacatggttgacggctatatggaaaacagcggcatgcatttgaacatcaacgtcttcaacaaggagaccctgattgatgctcagaagcacccagaagaatacccaacattgaccgttcgggtttctggctactgcgtctacttcgcagatttgaccaaggaacaacaagacgatgtcattgctcggaccttcttcgaagaaatgtaa

SEQ ID NO: 70 - protein, 753 aa, Lactobacillus casei
  MISC_FEATURE: bl23
MKQLDETKVPNYWEGFNGGDWQEEINVRDFIEHNLNQYDGDESFLAGPTEATTVLNNQVLNLKKQERANGGVLDADNNIPSTITSHGPGYLNKDLEKIVGVQTDKPFKRAFMPFGGIRMAEDALESYGFKTDPQEHKIFNEYRKTHNQGVFDAYTPDMRKARHYKIVTGLPDAYGRGRIVSDFPRIAVYGIDRLMAEKFKDYNLTGDGEMTDDVIKLREEINEQYRALNDMKKMAKEYGYDISRPAANAQEAVQWIYFGYLAAVKTQNGAAMSVGRIDTVIDAYIQRDMRLGKLNEEQAQELIDHLVMKLRMVRFIRTEEYNSLFSGDPIWATLSLAGMGNDGRHHVTKTAFRFLKTLDNMGAAPEPNITLLWSERLPEGFKRYATEVSIQSSTIQYENDDLMRNEWGTDYYGIACCVSAQPIADGVQYFGARANLAKTVLYAINGGKDEIQEAQVGPEYAPITSDYIDYKEFMNKFDKMMDWLADTYVNALNVIHYMHDKYYYEAAQLALKDTQLNRTFATGISGLSHAVDSISAIKYGHVKAIRDENGVAVDFVADNDDYPRYGNNDDRADDIAKWLVKTFYNKMNTHHLYRGAKLSTSVLTITSNVVYGKNTGTTPNGRQKGEPFSPGANPAYGAEKNGALASLMSTAKIPYHYATDGISNTFGVTPNTLGHDDETRKDTLVHMVDGYMENSGMHLNINVFNKETLIDAQKHPEEYPTLTVRVSGYCVYFADLTKEQQDDVIARTFFEEM

SEQ ID NO: 71 - DNA, 2262 bp, Lactobacillus casei
  misc_feature: ATCC 334
atgaaacagcttgacgaaaccaaagttcctaattattgggaaggctttaacggcggcgactggcaagaagaaattaatgtgcgcgattttatcgagcataacctgaaccaatatgacggggacgaaagtttccttgctggtcccactgaagcgacaacagtcctgaacaatcaggttctaaatttaaagaagcaagaacgtgcaaatggcggtgttttggatgctgacaacaatattccatctacgatcacctcacacggccctggttatttgaacaaagatcttgaaaagattgttggtgttcagaccgacaagccattcaaacgagcattcatgccatttggcggtattcgaatggctgaagatgcattggaatcttatggcttcaagacagatcctcaagaacacaagattttcaatgaatatcgtaagacccataaccaaggtgtctttgatgcttatacccctgatatgcgaaaggctcgccattacaagatcgtgactggcttgccagacgcatacggccgcggccggattgtttctgatttcccacggatcgctgtttacgggatcgatcgtttaatggctgagaagttcaaggattataacttgaccggcgacggcgaaatgactgacgatgtaatcaaattgcgtgaagaaatcaatgaacaatatcgtgccttaaacgacatgaagaagatggccaaggaatatggctatgacatctcgcgtccggcagctaatgcgcaagaagctgttcagtggatctactttggctatctggctgctgttaagactcaaaacggtgccgcaatgtccgttggccggatcgatacggttattgatgcttatatccaacgcgatatgcgcttaggcaaattgaacgaagaacaggcacaggaactgattgatcatttggttatgaaattgcggatggttcgtttcatccggactgaagaatataactcactgttctcaggcgatccaatctgggcaaccttgtcattggcaggaatgggcaatgatggccgtcaccacgttaccaagacggctttccgtttcctgaagactttggacaacatgggcgcagcaccagaaccaaacatcaccttgctttggagcgaacgcttgccagaaggctttaaacgctatgcaaccgaagtatccatccaaagttcaaccattcaatatgaaaatgatgacctgatgcgcaatgaatggggtaccgattactacggtattgcttgctgtgtctcggcacaaccaattgctgatggcgttcaatactttggtgcccgtgctaacttagctaagacggttctgtatgcgatcaacggtggtaaagatgaaattcaggaagcgcaagtagggcctgaatatgcaccgatcaccagcgattacattgattacaaagaattcatgaataagttcgacaagatgatggactggctggccgacacgtatgtcaatgctttgaatgtgattcactatatgcatgacaagtattattatgaagctgcacagctggcattgaaggatacccaactgaaccggaccttcgcaaccgggatttccggcctgtcacacgcggttgattccatcagtgcaatcaagtatggtcatgtcaaggcaattcgcgatgaaaatggtgttgcagttgacttcgttgctgacaatgatgactatccacgttatggtaacaacgatgatcgcgctgatgacatcgctaagtggttggttaagaccttctataacaagatgaacacgcatcatctgtatcgcggcgcgaagttgagtaccagtgtcctgaccattacttccaacgtggtttatggtaagaatacagggacaacaccaaacggtcgtcaaaaaggcgaaccattctcaccaggtgccaacccggcatacggcgcagaaaagaacggcgcattggcatccttgatgtccaccgccaagattccgtatcattacgcaactgacggcattagtaatacgtttggggttactccgaacacactgggccacgatgatgaaactcgtaaggataccttggttcacatggttgacggctatatggaaaacagcggcatgcatttgaacatcaacgtcttcaacaaggagaccctgattgatgctcagaagcacccagaagaatacccaacattgaccgttcgggtttctggctactgcgtctacttcgcagatttgaccaaggaacaacaagacgatgtcattgctcggaccttcttcgaagaaatgtaa

SEQ ID NO: 72 - protein, 753 aa, Lactobacillus casei; identical to SEQ ID NO: 70
  MISC_FEATURE: ATCC 334

SEQ ID NO: 73 - DNA, 2376 bp, Bifidobacterium adolescentis
atggcagcagttgatgcaacggcggtctcccaggaggaacttgaggctaaggcttgggaaggcttcaccgagggcaactggcagaaggacattgatgtccgcgacttcatccagaagaactacacgccatatgagggcgacgagtccttcctggctgacgccaccgacaagaccaagcacctgtggaagtatctggacgacaactatctgtccgtggagcgcaagcagcgcgtctacgacgtggacacccacaccccggcgggcatcgacgccttcccggccggctacatcgattccccggaagtcgacaatgtgattgtcggtctgcagaccgatgtgccgtgcaagcgcgccatgatgccgaacggcggctggcgtatggtcgagcaggccatcaaggaagccggcaaggagcccgatccggagatcaagaagatcttcaccaagtaccgcaagacccacaacgacggcgtcttcggcgtctacaccaagcagatcaaggtagctcgccacaacaagatcctcaccggcctgccggatgcctacggccgtggccgcatcatcggcgattaccgtcgtgtggccctgtacggcgtgaacgcgctgatcaagttcaagcagcgcgacaaggactccatcccgtaccgcaacgacttcaccgagccggagatcgagcactggatccgcttccgtgaggagcatgacgagcagatcaaggccctgaagcagctgatcaacctcggcaacgagtacggcctcgacctgtcccgcccggcacagaccgcacaggaagccgtgcagtggacctacatgggctacctcgcctccgtcaagagccaggacggcgccgccatgtccttcggccgtgtctccaccttcttcgacgtctacttcgagcgcgacctgaaggccggcaagatcaccgagaccgacgcacaggagatcatcgataacctggtcatgaagctgcgcatcgtgcgcttcctgcgcaccaaggattacgacgcgatcttctccggcgatccgtactgggcgacttggtccgacgccggcttcggcgacgacggccgtaccatggtcaccaagacctcgttccgtctgctcaacaccctgaccctcgagcacctcggacctggcccggagccgaacatcaccatcttctgggatccgaagctgccggaagcctacaagcgcttctgcgcccgaatctccatcgacacctcggccatccagtacgagtccgataaggaaatccgctcccactggggcgacgacgccgccatcgcatgctgcgtctccccgatgcgcgtgggcaagcagatgcagttcttcgccgcccgtgtgaactccgccaaggccctgctgtacgccatcaacggcggacgcgacgagatgaccggcatgcaggtcatcgacaagggcgtcatcgacccgatcaagccggaagccgatggcacgctggattacgagaaggtcaaggccaactacgagaaggccctcgaatggctgtccgagacctatgtgatggctctgaacatcatccattacatgcatgataagtacgcttacgagtccatcgagatggctctgcacgacaaggaagtgtaccgcaccctcggctgcggcatgtccggcctgtcgatcgcggccgactccctgtccgcatgcaagtacgccaaggtctacccgatctacaacaaggacgccaagaccacgccgggccacgagaacgagtacgtcgaaggcgccgatgacgatctgatcgtcggctaccgcaccgaaggcgacttcccgctgtacggcaacgatgatgaccgtgccgacgacatcgccaagtgggtcgtctccaccgtcatgggccaggtcaagcgtctgccggtgtaccgcgacgccgtcccgacccagtccatcctgaccatcacctccaatgtggaatacggcaaggccaccggcgccttcccgtccggccacaagaagggcaccccgtacgctccgggcgccaacccggagaacggcatggactcccacggcatgctgccgtccatgttctccgtcggcaagatcgactacaacgacgctcttgacggcatctcgctgaccaacaccatcacccctgatggtctgggccgcgacgaggaagagcgtatcggcaacctcgttggcatcctggacgccggcaacggccacggcctgtaccacgccaacatcaacgtgctgcgcaaggagcagctcgaggatgccgtcgagcatccggagaagtacccgcacctgaccgtgcgcgtctccggctacgcggtgaacttcgtcaagctcaccaaggaacagcagctcgacgtgatctcccgtacgttccaccagggcgctgtcgtcgactga

SEQ ID NO: 74 - protein, 791 aa, Bifidobacterium adolescentis
MAAVDATAVSQEELEAKAWEGFTEGNWQKDIDVRDFIQKNYTPYEGDESFLADATDKTKHLWKYLDDNYLSVERKQRVYDVDTHTPAGIDAFPAGYIDSPEVDNVIVGLQTDVPCKRAMMPNGGWRMVEQAIKEAGKEPDPEIKKIFTKYRKTHNDGVFGVYTKQIKVARHNKILTGLPDAYGRGRIIGDYRRVALYGVNALIKFKQRDKDSIPYRNDFTEPEIEHWIRFREEHDEQIKALKQLINLGNEYGLDLSRPAQTAQEAVQWTYMGYLASVKSQDGAAMSFGRVSTFFDVYFERDLKAGKITETDAQEIIDNLVMKLRIVRFLRTKDYDAIFSGDPYWATWSDAGFGDDGRTMVTKTSFRLLNTLTLEHLGPGPEPNITIFWDPKLPEAYKRFCARISIDTSAIQYESDKEIRSHWGDDAAIACCVSPMRVGKQMQFFAARVNSAKALLYAINGGRDEMTGMQVIDKGVIDPIKPEADGTLDYEKVKANYEKALEWLSETYVMALNIIHYMHDKYAYESIEMALHDKEVYRTLGCGMSGLSIAADSLSACKYAKVYPIYNKDAKTTPGHENEYVEGADDDLIVGYRTEGDFPLYGNDDDRADDIAKWVVSTVMGQVKRLPVYRDAVPTQSILTITSNVEYGKATGAFPSGHKKGTPYAPGANPENGMDSHGMLPSMFSVGKIDYNDALDGISLTNTITPDGLGRDEEERIGNLVGILDAGNGHGLYHANINVLRKEQLEDAVEHPEKYPHLTVRVSGYAVNFVKLTKEQQLDVISRTFHQGAVVD

SEQ ID NO: 75 - DNA, 2415 bp, Bifidobacterium longum
  misc_feature: NCC2705
gtgaagatgcgaaacctacaaccccatttaaggagtgacatgaccgcagtggaaaatgcagctgtctcccaggaggagctcgacgccaaggcgtgggccggcttcaccgagggcaactggcagaaggatattgacgtccgcgacttcatccagaagaactacaccccgtacgagggcgacgagacattcctggctcctgccaccgagaagaccaagcacctgtggaagtacctcgacgacaactacctggccgtggagcgcaagcagcgcgtctacgacgtggacacccataccccggccgacgtcgacgccttcccggccggctacatcgactccccggaagtcgataacgtggtcgttggcctccagaccgacgttccctgcaagcgcgcgatgatgccgaacggtggctggcgcatggtcgagcaggccatcaaggaagccggcaaggaaccggatccggagatcaagaagatcttcaccaagtaccgcaagacccacaacgacggcgtcttcggcgtgtacaccaagcagatcaaggtcgcccgccacaacaagatcctcaccggtctgccggacgcctacggccgtggccgcatcatcggcgactaccgccgcgtcgccctgtacggcgtgaacaagctcatcgccttcaagaagcgcgacaaggactccgtgccgtaccgcaacgacttcaccgagccggagatcgagcactggatccgcttccgtgaggagcacgacgagcagatcaaggccctgaagaagctcatcaacctcggcaacgagtacggcctcgacctgtcccgcccggcccagaccgcgcaggaagccgtgcagtggacctacatgggctacctggcctccatcaagtcccaggacggcgccgccatgtccttcggccgcaactccgccttcctcgactgctacatcgagcgcgacctccaggccggcaagatcaccgagaccgacgcccaggagctcatcgacaacatcgtcatgaagctgcgcatcgtgcgcttcctgcgtaccaaggactacgattcgatcttctccggcgacccgtactgggcgacctggtccgacgccggcttcggcgatgacggccgttcgatggtcaccaagacctcgttccgtctgctcaacaccctgaccctcgagcacctcggacctggccccgagccgaacatcaccatcttctgggatccgaagctgcctgaggcctacaagcgcttctgcgccaagatctccatcgacacctcggccatccagtacgagtccgacaaggagattcgtagccactggggcgacgacgcggctatcgcatgctgcgtgtccccgatgcgtgtcggcaagcagatgcagttcttcgccgcccgcgtgaactccgccaaggccctgctgtacgccatcaacggcggccgcgacgagatgaccggcatgcaggtcatcgacaagggcgtgatcgagccgattaccccggaggccgacggcaccctggactacgagaaggtcaagaacaactacgagaaggctctcgagtggctgtccgagacctacgtcatggccctgaacatcatccactacatgcacgataagtacgcgtacgagtccatcgagatggccctgcacgacaaggaagtgtaccgcaccctcggctgcggcatgtccggtctgtccatcgccgccgactccctcgccgccgtcaagtacgccaaggtctacccgatctacaacaaggacgcgaagaccctggaaggccacgagtacgagtacgttgagggcgccgacgacgacctgatcgtcggctaccgcaccgagggcgagttcccggtctacggcaacgacgacgaccgcgccgacgacatcgccaagtgggtcgtctccacggtcatgggccaggtcaagaggctcccggtctaccgcggcgccgtcccgacccagtccatcctgacgatcacctccaacgtcgagtacggcaagaacaccggttccttcccgtccggccacgccaagggcaccccgtacgctccgggcgccaacccggagaacggcatggactcccacggcatgctgccgtccatgttctccgtcggcaagatcgactacaacgacgctcttgacggcatctcgctgaccaacaccatcacccctgatggcctgggccgcgacgaggacgagcgcatcggcaacctggtcggcatcctggacgccggcaacggccacggcctctaccacgcgaacatcaacgttctgcgcaaggagaccatggaggacgccgtcgagcaccccgaaaagtacccgcacctgaccgtgcgtgtctccggctacgcggtgaacttcgtcaagctcaccaaggagcagcagctcgacgtcatctcccgtaccttccaccagggtgccgtcgtcgactga

SEQ ID NO: 76 - protein, 804 aa, Bifidobacterium longum
  MISC_FEATURE: NCC2705
MKMRNLQPHLRSDMTAVENAAVSQEELDAKAWAGFTEGNWQKDIDVRDFIQKNYTPYEGDETFLAPATEKTKHLWKYLDDNYLAVERKQRVYDVDTHTPADVDAFPAGYIDSPEVDNVVVGLQTDVPCKRAMMPNGGWRMVEQAIKEAGKEPDPEIKKIFTKYRKTHNDGVFGVYTKQIKVARHNKILTGLPDAYGRGRIIGDYRRVALYGVNKLIAFKKRDKDSVPYRNDFTEPEIEHWIRFREEHDEQIKALKKLINLGNEYGLDLSRPAQTAQEAVQWTYMGYLASIKSQDGAAMSFGRNSAFLDCYIERDLQAGKITETDAQELIDNIVMKLRIVRFLRTKDYDSIFSGDPYWATWSDAGFGDDGRSMVTKTSFRLLNTLTLEHLGPGPEPNITIFWDPKLPEAYKRFCAKISIDTSAIQYESDKEIRSHWGDDAAIACCVSPMRVGKQMQFFAARVNSAKALLYAINGGRDEMTGMQVIDKGVIEPITPEADGTLDYEKVKNNYEKALEWLSETYVMALNIIHYMHDKYAYESIEMALHDKEVYRTLGCGMSGLSIAADSLAAVKYAKVYPIYNKDAKTLEGHEYEYVEGADDDLIVGYRTEGEFPVYGNDDDRADDIAKWVVSTVMGQVKRLPVYRGAVPTQSILTITSNVEYGKNTGSFPSGHAKGTPYAPGANPENGMDSHGMLPSMFSVGKIDYNDALDGISLTNTITPDGLGRDEDERIGNLVGILDAGNGHGLYHANINVLRKETMEDAVEHPEKYPHLTVRVSGYAVNFVKLTKEQQLDVISRTFHQGAVVD

SEQ ID NO: 77 - DNA, 2376 bp, Bifidobacterium longum
  misc_feature: DJO10A
atgaccgcagtggaaaatgcagctgtctcccaggaggagctcgacgccaaggcgtgggccggcttcaccgagggcaactggcagaaggatattgacgtccgcgacttcatccagaagaactacaccccgtacgagggcgacgagacattcctggctcctgccaccgagaagaccaagcacctgtggaagtacctcgacgacaactacctggccgtggagcgcaagcagcgcgtctacgacgtggacacccataccccggccgacgtcgacgccttcccggccggctacatcgactccccggaagtcgataacgtggtcgttggcctccagaccgacgttccctgcaagcgcgcgatgatgccgaacggtggctggcgcatggtcgagcaggccatcaaggaagccggcaaggaaccggatccggagatcaagaagatcttcaccaagtaccgcaagacccacaacgacggcgtcttcggcgtgtacaccaagcagatcaaggtcgcccgccacaacaagatcctcaccggtctgccggacgcctacggccgtggccgcatcatcggcgactaccgccgcgtcgccctgtacggcgtgaacaagctcatcgccttcaagaagcgcgacaaggactccgtgccgtaccgcaacgacttcaccgagccggagatcgagcactggatccgcttccgtgaggagcacgacgagcagatcaaggccctgaagaagctcatcaacctcggcaacgagtacggcctcgacctgtcccgcccggcccagaccgcgcaggaagccgtgcagtggacctacatgggctacctggcctccatcaagtcccaggacggcgccgccatgtccttcggccgcaactccgccttcctcgactgctacatcgagcgcgacctccaggccggcaagatcaccgagaccgacgcccaggagctcatcgacaacatcgtcatgaagctgcgcatcgtgcgcttcctgcgtaccaaggactacgattcgatcttctccggcgacccgtactgggcgacctggtccgacgccggcttcggcgatgacggccgttcgatggtcaccaagacctcgttccgtctgctcaacaccctgaccctcgagcacctcggacctggccccgagccgaacatcaccatcttctgggatccgaagctgcctgaggcctacaagcgcttctgcgccaagatctccatcgacacctcggccatccagtacgagtccgacaaggagattcgcagccactggggcgacgacgctgctatcgcctgctgcgtgtccccgatgcgtgtcggcaagcagatgcagttcttcgccgcccgcgtgaactccgccaaggccctgctgtacgccatcaacggcggccgcgacgagatgaccggcatgcaggtcatcgacaagggcgtgatcgagccgattaccccggaggccgacggcaccctggactacgagaaggtcaagaacaactacgagaaggctctcgagtggctgtccgagacctacgtcatggccctgaacatcatccactacatgcacgataagtacgcgtacgagtccatcgagatggccctgcacgacaaggaagtgtaccgcaccctcggctgcggcatgtccggtctgtccatcgccgccgactccctcgccgccgtcaagtacgccaaggtctacccgatctacaacaaggacgcgaagaccctggaaggccacgagtacgagtacgttgagggcgccgacgacgacctgatcgtcggctaccgcaccgagggcgagttcccggtctacggcaacgacgacgaccgcgccgacgacatcgccaagtgggtcgtctccacggtcatgggccaggtcaagaggctcccggtctaccgcggcgccgtcccgacccagtccatcctgacgatcacctccaacgtcgagtacggcaagaacaccggttccttcccgtccggccacgccaagggcaccccgtacgctccgggcgccaacccggagaacggcatggactcccacggcatgctgccgtccatgttctccgtcggcaagatcgactacaacgacgctcttgacggcatctcgctgaccaacaccatcacccctgatggcctgggccgcgacgaggacgagcgcatcggcaacctggtcggcatcctggacgccggcaacggccacggcctctaccacgcgaacatcaacgttctgcgcaaggagaccatggaggacgccgtcgagcaccccgaaaagtacccgcacctgaccgtgcgtgtctccggctacgcggtgaacttcgtcaagctcaccaaggagcagcagctcgacgtcatctcccgtaccttccaccagggtgccgtcgtcgactga

SEQ ID NO: 78 - protein, 791 aa, Bifidobacterium longum
  MISC_FEATURE: DJO10A
MTAVENAAVSQEELDAKAWAGFTEGNWQKDIDVRDFIQKNYTPYEGDETFLAPATEKTKHLWKYLDDNYLAVERKQRVYDVDTHTPADVDAFPAGYIDSPEVDNVVVGLQTDVPCKRAMMPNGGWRMVEQAIKEAGKEPDPEIKKIFTKYRKTHNDGVFGVYTKQIKVARHNKILTGLPDAYGRGRIIGDYRRVALYGVNKLIAFKKRDKDSVPYRNDFTEPEIEHWIRFREEHDEQIKALKKLINLGNEYGLDLSRPAQTAQEAVQWTYMGYLASIKSQDGAAMSFGRNSAFLDCYIERDLQAGKITETDAQELIDNIVMKLRIVRFLRTKDYDSIFSGDPYWATWSDAGFGDDGRSMVTKTSFRLLNTLTLEHLGPGPEPNITIFWDPKLPEAYKRFCAKISIDTSAIQYESDKEIRSHWGDDAAIACCVSPMRVGKQMQFFAARVNSAKALLYAINGGRDEMTGMQVIDKGVIEPITPEADGTLDYEKVKNNYEKALEWLSETYVMALNIIHYMHDKYAYESIEMALHDKEVYRTLGCGMSGLSIAADSLAAVKYAKVYPIYNKDAKTLEGHEYEYVEGADDDLIVGYRTEGEFPVYGNDDDRADDIAKWVVSTVMGQVKRLPVYRGAVPTQSILTITSNVEYGKNTGSFPSGHAKGTPYAPGANPENGMDSHGMLPSMFSVGKIDYNDALDGISLTNTITPDGLGRDEDERIGNLVGILDAGNGHGLYHANINVLRKETMEDAVEHPEKYPHLTVRVSGYAVNFVKLTKEQQLDVISRTFHQGAVVD

SEQ ID NO: 79 - DNA, 2379 bp, Bifidobacterium animalis
  misc_feature: DSM 10140
atgtcagcaattgaaaacgtggccgaggtgtccccggaagccatcaaggaacaggcttgggaggggttcgttcccggcaactgggagaaggacatcgacgttcgtgacttcattcagaagaactacacgccttacgagggtgatgaatcgttcctcgcggatgcgaccgacaagacgaagtacctgtggaagtacctcgacgacaactatctggcggtggagcgcaagcagcgtgtctatgatgtggacacccacacgccggcggatatcgacgccttcccggctggctatatcgattccccggagatcgacaatgtgatcgtcggcctgcagaccgatgagccatgcaagcgagccatgatgccgaatggcggttggcgcatggtggagcaggccatcaaggaggccggcaaggagccggacccggcgatcaagaagatcttcaccaagtaccgcaagacgcataacgacggtgtgttcggcgtctatacgaagaacatcaaagtggcacgccacaacaagattctcaccggcctgccggatgcctacggccgcggccgcatcatcggcgactaccgtcgtgtggccctgtatggcgtggatgcgctgattaagttcaagcagcgtgacaaggacgccatcccgtaccgcaacgacttctcggagaccgagatcgagcactggatccgttaccgcgaggagcacgacgagcagattaaggctctgaagaagctcatcaacctaggcaaggaatacggactcgatttggcgcgccccgccatgaacgcgcgtgaggccgtgcagtggacctacatgggctacctcgcctccatcaagagccaggacggcgccgcgatgagcttcggccgcgtgtcagcgttcttcgacatctacttcgagcgcgatctcaaggaaggcaagatcaccgagaccgacgcccaggagatcatcgacaatctggtgatgaagctgcgcatcgtgcgattcctgcgcaccaaggactacgattcgatcttctcgggcgacccctactgggcgacatggtcggatgcaggcttcggcgacgatggccgcaccatggtcaccaagacgtcgttccgtctgctcaacacgctcacgctcgagcatttgggaccgggacccgaaccgaacatcacgattttctgggatccgaagctgccggaaggctacaagcgtttctgcgcccagatctccattgatacctcggccatccagtatgaatccgacaaggagatccgcaaccattggggtgacgatgcggccattgcatgctgcgtctccccgatgcgtgtgggcaagcaaatgcagttcttcgcggctcgcgtgaactccgccaaggcgctgctctacgcgatcaacggcggccgtgacgagatgaccggcatgcaggtgatcgacaagggcatcatcgagccgatccagcccgaggctgacggcacgctcgattacgagaaggtgaaggccaactatgagaaggccctcgaatggctttcggagacctacgtcgaagcgctgaacatcattcattacatgcatgacaagtatgcgtatgagtccatcgagatggcgctgcacgaccgcgaggtctaccgcaccctgggctgcggcatgtccggcctgtcgatcgccgccgattcgctttccgcatgcaagtacgccaaggtgtacccaatctacaacaaggacgccaaggacatgccgggtcacgagtacgaatatgtcgaaggcgcggacgacgatctggtggtcggctaccgcaccgagggcgagttcccgctttacggcaacgacgacgatcgtgccgatgacattgccaagtgggtcgtgtccaccgtcatgggccaggtcaagcgcctgccggtgtatcgtggtgccgtccccacgcagtcgatcctcacgatcacctcgaacgtcgagtatggcaagaacaccggatccttcccgtcgggccacgccaagggaacgccgtacgccccgggcgcgaacccggagaacggcatggactcccatggcatgctcccctcgatgttctcggtgggcaagatcgattacaacgacgcccttgacggcatctcgctgacgaacacgatcacacccgacggcctgggccgcgatgaggacgaacgcatcagcaacctcgtcggcatcctcgacgcaggcaacggccatggactgtaccatgcgaacatcaacgtgctgcgcaaggaacagctcgaagacgccgtggagcacccggagaagtacccgcacctgaccgtgcgcgtctccggttacgccgtgaacttcgtcaagcttacgaaggaacagcagcttgacgtcatttcccgcaccttccatcagggcgcggtcgaggactaa

SEQ ID NO: 80 - protein, 792 aa, Bifidobacterium animalis
  misc_feature: DSM 10140
MSAIENVAEVSPEAIKEQAWEGFVPGNWEKDIDVRDFIQKNYTPYEGDESFLADATDKTKYLWKYLDDNYLAVERKQRVYDVDTHTPADIDAFPAGYIDSPEIDNVIVGLQTDEPCKRAMMPNGGWRMVEQAIKEAGKEPDPAIKKIFTKYRKTHNDGVFGVYTKNIKVARHNKILTGLPDAYGRGRIIGDYRRVALYGVDALIKFKQRDKDAIPYRNDFSETEIEHWIRYREEHDEQIKALKKLINLGKEYGLDLARPAMNAREAVQWTYMGYLASIKSQDGAAMSFGRVSAFFDIYFERDLKEGKITETDAQEIIDNLVMKLRIVRFLRTKDYDSIFSGDPYWATWSDAGFGDDGRTMVTKTSFRLLNTLTLEHLGPGPEPNITIFWDPKLPEGYKRFCAQISIDTSAIQYESDKEIRNHWGDDAAIACCVSPMRVGKQMQFFAARVNSAKALLYAINGGRDEMTGMQVIDKGIIEPIQPEADGTLDYEKVKANYEKALEWLSETYVEALNIIHYMHDKYAYESIEMALHDREVYRTLGCGMSGLSIAADSLSACKYAKVYPIYNKDAKDMPGHEYEYVEGADDDLVVGYRTEGEFPLYGNDDDRADDIAKWVVSTVMGQVKRLPVYRGAVPTQSILTITSNVEYGKNTGSFPSGHAKGTPYAPGANPENGMDSHGMLPSMFSVGKIDYNDALDGISLTNTITPDGLGRDEDERISNLVGILDAGNGHGLYHANINVLRKEQLEDAVEHPEKYPHLTVRVSGYAVNFVKLTKEQQLDVISRTFHQGAVED

SEQ ID NO: 81 - DNA, 2226 bp, Clostridium cellulolyticum
atggatccatggagatatttcaaaaacggaaattggtccgaggaaatagatgtaagggattttattattaataattatataccatataaaggagatgattcctttttaaaaggccctactgaaaagactcaaaaactctggaaaaaagtcagtggtatccttgacgaggaaagagagaacggaggagttctcgatgttgataccaaaataatatcaactatcacttcgcatgaacccggatatattgataaggatttggaaaagattgtaggattgcagacggataaacctctaaaaaggggtataatgcctttcggtggtatcaggatggtagtaaagggcggagaggcctacggcaaaaagattgacgaaagtgttgtaaagctatttactgaatataggaagactcacaatgacggtgtttacgatgtctatactcccgaaatgatgagggcgaaaaaagcaggtattataaccgggcttcctgatgcatacggtagaggaagaataatcggtgattacagaagagttgcactgtatggggttgacaggcttatcggagataagcaaaaacaacttacaagcctagaaatggattacatggacagtgaaaccatacaggaaagggaagaaagaaaaagtcagataaaagctcttgagtacttaaagcaaatggctgaaatgtatggctttgatatttcaaggcctgctgaaaccgcacaggaagcatttcaatggttgtatttcggtttcctcggagcagtaaaggagcagaatggtgcggctatgagtcttggaagagtttcaacattccttgatatttatatagaaagggatatgaaggaggggacacttaccgaagaagaggcacaggagcttgttgaccattttgttatgaagcttagattagtaagattcctgagaactccagagtatgagaaactgttctcaggtgaccctacatggataaccgaaagcattggaggtatgggtcttgacggacgtactctggtaacgaagaattccttcagaatgctgcataccctatttaatctgggtcatgcacccgagcccaatatgacggtgctttggtcggtgcatctgcctgatggctttaagaaatactgctcatatgtttctatcaatacaagctctatccaatacgagagcgatgatataatgaggtattattggggagacgactacggcatagcatgctgtgtttcagccatgagaataggaaagcagatgcagttcttcggagcccgctgcaatatggcgaaagctttgttgtatgcaattaacggggggcgtgatgaaaaatcgggcgttcaggtaggacctataatgcaggctattgagactgaatatcttgattatgatgatgtaataaagaggttcgacgcagtactaacatgggttgcaagactttacatcaacactctgaatataatacactatatgcatgacaagtacgcttatgaaagactacagatggctttgcacgacaaggacatattaagaacaatggcctgcggaatagcaggattatctgtagttgcggattctctgagtgcaattaaatatgcaaaggtaaaggtaataagaaatgaagaggggcttgccgttgactatgacatagaaggtgattatccgaaatttggaaataacgacgaccgtgtagacaatatagccgtaatgctggtaaaaagctttatggagaagctggaaaagcagagaacctacaggcactctgttcctaccctttcaatactgactattacatcaaatgttgtatacggagctaagacaggtaatacacctgacggaagaaaagcgggagaacccttcggaccgggtgcaaacccaatgcacggaagagacttgaacggtgcacttgcagttcttaaatccatttcaaagctgccttaccagtttgcacaggacggtatatcatacactttttcaatagtaccaaaggcacttggaaaagaggaagatacaaggatcaacaaccttgtgtcactgcttgactcttactttaaagaaggcggacatcacattaatatcaatgtatttgagagagaaatgctgctggatgcaatggatcatcctgaaaagtacccacagctcacaatcagggtatccggctatgcggtaaactttataaaattgacgagggaacagcagctagatgtaattaacagaacgatacatgaaaatata

SEQ ID NO: 82 - protein, 742 aa, Clostridium cellulolyticum
MDPWRYFKNGNWSEEIDVRDFIINNYIPYKGDDSFLKGPTEKTQKLWKKVSGILDEERENGGVLDVDTKIISTITSHEPGYIDKDLEKIVGLQTDKPLKRGIMPFGGIRMVVKGGEAYGKKIDESVVKLFTEYRKTHNDGVYDVYTPEMMRAKKAGIITGLPDAYGRGRIIGDYRRVALYGVDRLIGDKQKQLTSLEMDYMDSETIQEREERKSQIKALEYLKQMAEMYGFDISRPAETAQEAFQWLYFGFLGAVKEQNGAAMSLGRVSTFLDIYIERDMKEGTLTEEEAQELVDHFVMKLRLVRFLRTPEYEKLFSGDPTWITESIGGMGLDGRTLVTKNSFRMLHTLFNLGHAPEPNMTVLWSVHLPDGFKKYCSYVSINTSSIQYESDDIMRYYWGDDYGIACCVSAMRIGKQMQFFGARCNMAKALLYAINGGRDEKSGVQVGPIMQAIETEYLDYDDVIKRFDAVLTWVARLYINTLNIIHYMHDKYAYERLQMALHDKDILRTMACGIAGLSVVADSLSAIKYAKVKVIRNEEGLAVDYDIEGDYPKFGNNDDRVDNIAVMLVKSFMEKLEKQRTYRHSVPTLSILTITSNVVYGAKTGNTPDGRKAGEPFGPGANPMHGRDLNGALAVLKSISKLPYQFAQDGISYTFSIVPKALGKEEDTRINNLVSLLDSYFKEGGHHININVFEREMLLDAMDHPEKYPQLTIRVSGYAVNFIKLTREQQLDVINRTIHENI

SEQ ID NO: 83 - DNA, 2283 bp, Escherichia coli
atgtccgagcttaatgaaaagttagccacagcctgggaaggttttaccaaaggtgactggcagaatgaagtaaacgtccgtgacttcattcagaaaaactacactccgtacgagggtgacgagtccttcctggctggcgctactgaagcgaccaccaccctgtgggacaaagtaatggaaggcgttaaactggaaaaccgcactcacgcgccagttgactttgacaccgctgttgcttccaccatcacctctcacgacgctggctacatcaacaagcagcttgagaaaatcgttggtctgcagactgaagctccgctgaaacgtgctcttatcccgttcggtggtatcaaaatgatcgaaggttcctgcaaagcgtacaaccgcgaactggatccgatgatcaaaaaaatcttcactgaataccgtaaaactcacaaccagggcgtgttcgacgtttacactccggacatcctgcgttgccgtaaatctggtgttctgaccggtctgccagatgcatatggccgtggccgtatcatcggtgactaccgtcgcgttgcgctgtacggtatcgactacctgatgaaagacaaactggcacagttcacttctctgcaggctgatctggaaaacggcgtaaacctggaacagactatccgtctgcgcgaagaaatcgctgaacagcaccgcgctctgggtcagatgaaagaaatggctgcgaaatacggctacgacatctctggtccggctaccaacgctcaggaagctatccagtggacttacttcggctacctggctgctgttaagtctcagaacggtgctgcaatgtccttcggtcgtacctccaccttcctggatgtgtacatcgaacgtgacctgaaagctggcaagatcaccgaacaagaagcgcaggaaatggttgaccacctggtcatgaaactgcgtatggttcgcttcctgcgtactccggaatacgatgaactgttctctggcgacccgatctgggcaaccgaatctatcggtggtatgggcctcgacggtcgtaccctggttaccaaaaacagcttccgtttcctgaacaccctgtacaccatgggtccgtctccggaaccgaacatgaccattctgtggtctgaaaaactgccgctgaacttcaagaaattcgccgctaaagtgtccatcgacacctcttctctgcagtatgagaacgatgacctgatgcgtccggacttcaacaacgatgactacgctattgcttgctgcgtaagcccgatgatcgttggtaaacaaatgcagttcttcggtgcgcgtgcaaacctggcgaaaaccatgctgtacgcaatcaacggcggcgttgacgaaaaactgaaaatgcaggttggtccgaagtctgaaccgatcaaaggcgatgtcctgaactatgatgaagtgatggagcgcatggatcacttcatggactggctggctaaacagtacatcactgcactgaacatcatccactacatgcacgacaagtacagctacgaagcctctctgatggcgctgcacgaccgtgacgttatccgcaccatggcgtgtggtatcgctggtctgtccgttgctgctgactccctgtctgcaatcaaatatgcgaaagttaaaccgattcgtgacgaagacggtctggctatcgacttcgaaatcgaaggcgaatacccgcagtttggtaacaatgatccgcgtgtagatgacctggctgttgacctggtagaacgtttcatgaagaaaattcagaaactgcacacctaccgtgacgctatcccgactcagtctgttctgaccatcacttctaacgttgtgtatggtaagaaaacgggtaacaccccagacggtcgtcgtgctggcgcgccgttcggaccgggtgctaacccgatgcacggtcgtgaccagaaaggtgcagtagcctctctgacttccgttgctaaactgccgtttgcttacgctaaagatggtatctcctacaccttctctatcgttccgaacgcactgggtaaagacgacgaagttcgtaagaccaacctggctggtctgatggatggttacttccaccacgaagcatccatcgaaggtggtcagcacctgaacgttaacgtgatgaaccgtgaaatgctgctcgacgcgatggaaaacccggaaaaatatccgcagctgaccatccgtgtatctggctacgcagtacgtttcaactcgctgactaaagaacagcagcaggacgttattactcgtaccttcactcaatctatgtaa

SEQ ID NO: 84 - protein, 760 aa, Escherichia coli
MSELNEKLATAWEGFTKGDWQNEVNVRDFIQKNYTPYEGDESFLAGATEATTTLWDKVMEGVKLENRTHAPVDFDTAVASTITSHDAGYINKQLEKIVGLQTEAPLKRALIPFGGIKMIEGSCKAYNRELDPMIKKIFTEYRKTHNQGVFDVYTPDILRCRKSGVLTGLPDAYGRGRIIGDYRRVALYGIDYLMKDKLAQFTSLQADLENGVNLEQTIRLREEIAEQHRALGQMKEMAAKYGYDISGPATNAQEAIQWTYFGYLAAVKSQNGAAMSFGRTSTFLDVYIERDLKAGKITEQEAQEMVDHLVMKLRMVRFLRTPEYDELFSGDPIWATESIGGMGLDGRTLVTKNSFRFLNTLYTMGPSPEPNMTILWSEKLPLNFKKFAAKVSIDTSSLQYENDDLMRPDFNNDDYAIACCVSPMIVGKQMQFFGARANLAKTMLYAINGGVDEKLKMQVGPKSEPIKGDVLNYDEVMERMDHFMDWLAKQYITALNIIHYMHDKYSYEASLMALHDRDVIRTMACGIAGLSVAADSLSAIKYAKVKPIRDEDGLAIDFEIEGEYPQFGNNDPRVDDLAVDLVERFMKKIQKLHTYRDAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMENPEKYPQLTIRVSGYAVRFNSLTKEQQQDVITRTFTQSM

SEQ ID NO: 85 - DNA, 594 bp, Chlamydomonas reinhardtii
  misc_feature: PflA1
atgttgaaggctgcgttgccacgaattatgaacgctgctagcatgtcttgtgcagctactgggctgcagcgctccggtccgctggcgatgaacgctgcgactacatcgcgaacggggcccgcttcagggcttccgaaacattcctggggtgccagtgctcgacgagcatttgttgcacctgccactatctcggaacggctgcagccgaagctctcgacgaattactcggtggttctgccgcaatacgagcccacggatccctcgggcatccctgaggttttcggaaacgtgcattcaacagaaagcatgagcgcggtggacggccctggcgtacggtggtccgcaactacctcaagccacgcggcggcatcaccatcagcggcggcgaggccatgctgcagccacactttgtgtccaccgtgttccaggttccagggcattgagctgctgccgtaccacgtgttgggccgcaacaagtgggaggtcatggggctgccgtaccccctggacggcacgaacacgccgccgcacgagcaggtacgggccgtgatcaaggtgttcaacgacaacgacgttcccgtcatctgcgccgag

SEQ ID NO: 86 - protein, 198 aa, Chlamydomonas reinhardtii
  MISC_FEATURE: PflA1
MLKAALPRIMNAASMSCAATGLQRSGPLAMNAATTSRTGPASGLPKHSWGASARRAFVAPATISERLQPKLSTNYSVVLPQYEPTDPSGIPEVFGNVHSTESMSAVDGPGVRWSATTSSHAAASPSAAARPCCSHTLCPPCSRFQGIELLPYHVLGRNKWEVMGLPYPLDGTNTPPHEQVRAVIKVFNDNDVPVICAE

SEQ ID NO: 87 - DNA, 801 bp, Neocallimastix frontalis
atgccagctatcgttgatccaactactatggattatatggaagtcaagggcaatgtccattcaactgaaagtttggcttgtcttgaaggtccaggaaacagattccttttatttttaaatggttgtgctgctcgttgcttatactgtagtaatccagatacttgggatgaaactgttggtactccaatgaccgttggccaacttattaagaagattggaaatcttaaaaactactatatcaattctgttggtggtggtggtgtcactgtttctggtggtgaaccattaactcaatttggtttcttatcttgtttcttatatgctgtcaagaagcacttaaatcttcatacctgtgttgaaaccactggtcaaggttgtactaaggcttggaattcagttttacctcatactgacttatgcttagtatgtattaaacatgctattccagaaaaatacgaacaaattactcgtactaagaaattagatagatgtcttaagttccttaaggaattagaaaagagaaacattccatggtggtgtcgttacgttgttcttccaggttacactgattctaaggaagatattgaagctttaattgaattagttaagaacagtccaacttgtgaaagaattgaattccttccataccccgaattaggtaaaaacaaatgggaagaattaggtattgaatatccattaaagaatattaaacaacttaagaaaagtgaaattaaatggatctgtgatatggtccgtgaagctttcaaggaccgtaatattccagttactggtgatacttaa

SEQ ID NO: 88 - protein, 266 aa, Neocallimastix frontalis
MPAIVDPTTMDYMEVKGNVHSTESLACLEGPGNRFLLFLNGCAARCLYCSNPDTWDETVGTPMTVGQLIKKIGNLKNYYINSVGGGGVTVSGGEPLTQFGFLSCFLYAVKKHLNLHTCVETTGQGCTKAWNSVLPHTDLCLVCIKHAIPEKYEQITRTKKLDRCLKFLKELEKRNIPWWCRYVVLPGYTDSKEDIEALIELVKNSPTCERIEFLPYPELGKNKWEELGIEYPLKNIKQLKKSEIKWICDMVREAFKDRNIPVTGDT

SEQ ID NO: 89 - DNA, 2496 bp, Chlamydomonas reinhardtii
  misc_feature: PflA
atgttaacacccttaagctatcctatcatcaacaccgtctcgtcaagtctgccagcgcttcacgccatgagccagatgctgctggagaagacaatgcgccggggcctcgccacggtctcggccgcagcgagctccgctgttggccggcccatccccatggctgttaggtcgccgatgcgctcgatggccgctgccagcgcggccgctgaggccctcccggtggcacccagccacagctgcgctgctgaccccgacaagcacccgcacctgcccgacccccgcccgaagccggccgtggacgcgggcatcaacgtccagaagtatgtgcaggacaactacaccgcttacgccggcaactcgtccttcctggctggccccactgacaacaccaagaagctgtggagcgagctggagaagatgattgccaccgagatcgagaagggcgtgatggacgtggatccctccaagccctccaccatcaccgccttcccgcccggctacatcgacaaggacctggagacggtggtggggctgcagaccgacgcgccgctcaagcgcgccatcaagcccctgggcggcgtcaacatggtcaaggcggcgctggagtcgtacggctacacccccgaccccgaggtggcccgcctgtacagcacggtgcgcaagacgcacaacagcggcgtgtttgacgcctacacggacgagatgcgcgccgcgcgcaagagcggcatcctgtccggcctgcccgacggctacggccgcggccgcatcatcggcgactaccgccgcgtggcgctgtacggcgtggacgcgctgatcaaggccaagaagaccgacctgaagcacaacctgctgggcgtgatggacgaggagaagatccgcctgcgcgaggaggtgaacgagcagatccgcgcgctcagcgagctcaaggagatgggcgccgcctacggcttcgacctgagccgccccgccgccaactcgcgcgaggcggtgcagtggctgtacttcggctacctgggcgccgtcaaggagcaggacggcgccgccatgagcctgggccgcatcgacgccttcctggacacctactttgagcgcgacctcaaggccggcaccatcactgaggccgaggtgcaggagctgatcgaccacttcgtcatgaagctgcgcatcgtgcgccagctgcgcacgcccgagtacaacgcgctgtttgccggcgaccccacctgggtcacctgcgtgctgggcggcactgacgccagcggcaaggccatggtcaccaagaccagcttccgcctgctcaacaccctgtacaacctgggccccgcgcccgagcccaacctgacggtgctgtggaacgacaacctgcccgcgcccttcaaggagttctgcgccaaggtgtcgctggacaccagctccatccagtacgagtccgacaacctcatgagcaagctgtttggctccgactactccatcgcctgctgcgtgtcggccatgcgcgtgggcaaggacatgcagtactttggcgcccgcgccaacctgcccaagctgctgctgtacacgctcaacggcggccgcgacgaggtgtcgggcgaccaggtggggcccaagttcgcgccggtgcgcagccccaccgcgccgttggactatgaggaggtcaaggccaagatcgaggacggcatggagtggctggcctccatgtacgcgaacaccatgaacatcatccactacatgcacgacaagtacgactacgagcggctgcagatggcgctgcacgacacgcacgtgcgccgcctgctggcgttcggcatcagcggcctgtccgtggtgaccgactcgctgtcggccatcaagtacgcccaggtgacgcccgtgattgacgagcgcggcctcatgacggacttcaaggtggagggcagcttccccaagtacggcaacgacgatgaccgcgtggacgagatcgccgagtgggtggtgtccaccttctccagcaagctggccaagcagcacacctaccgcaactcggtgcccacgctgtcggtgctgaccatcacctccaacgtggtgtacggcaagaagacgggctccacccccgacggccgcaagaagggcgagcccttcgcgcccggcgccaacccgctgcacggccgcgacgcccacggcgctctggcctcgctcaactcggtggccaagctgccctacaccatgtgcctggacggcatctccaacaccttctcgctcatcccccaggtgctgggcaggggcggcgagcacgagcgcgccaccaacctggcctccatcctggacggctactttgccaacggcggccaccacatcaacgtcaacgtgctcaaccgctccatgctcatggacgccgtggagcaccccgagaagtaccccaacctcaccatccgcgtgtccgggtacgctgtgcacttcgcgcgcctcacgcgcgagcagcagctggaggtgatcgcgcgcaccttccacgacaccatgtaa

SEQ ID NO: 90 - protein, 831 aa, Chlamydomonas reinhardtii
  MISC_FEATURE: PflA
MLTPLSYPIINTVSSSLPALHAMSQMLLEKTMRRGLATVSAAASSAVGRPIPMAVRSPMRSMAAASAAAEALPVAPSHSCAADPDKHPHLPDPRPKPAVDAGINVQKYVQDNYTAYAGNSSFLAGPTDNTKKLWSELEKMIATEIEKGVMDVDPSKPSTITAFPPGYIDKDLETVVGLQTDAPLKRAIKPLGGVNMVKAALESYGYTPDPEVARLYSTVRKTHNSGVFDAYTDEMRAARKSGILSGLPDGYGRGRIIGDYRRVALYGVDALIKAKKTDLKHNLLGVMDEEKIRLREEVNEQIRALSELKEMGAAYGFDLSRPAANSREAVQWLYFGYLGAVKEQDGAAMSLGRIDAFLDTYFERDLKAGTITEAEVQELIDHFVMKLRIVRQLRTPEYNALFAGDPTWVTCVLGGTDASGKAMVTKTSFRLLNTLYNLGPAPEPNLTVLWNDNLPAPFKEFCAKVSLDTSSIQYESDNLMSKLFGSDYSIACCVSAMRVGKDMQYFGARANLPKLLLYTLNGGRDEVSGDQVGPKFAPVRSPTAPLDYEEVKAKIEDGMEWLASMYANTMNIIHYMHDKYDYERLQMALHDTHVRRLLAFGISGLSVVTDSLSAIKYAQVTPVIDERGLMTDFKVEGSFPKYGNDDDRVDEIAEWVVSTFSSKLAKQHTYRNSVPTLSVLTITSNVVYGKKTGSTPDGRKKGEPFAPGANPLHGRDAHGALASLNSVAKLPYTMCLDGISNTFSLIPQVLGRGGEHERATNLASILDGYFANGGHHINVNVLNRSMLMDAVEHPEKYPNLTIRVSGYAVHFARLTREQQLEVIARTFHDTM

SEQ ID NO: 91 - DNA, 2418 bp, Piromyces sp. E2
atggaaagcttagctttatccaatgtcagtgttcttgctaacactgtttctgttaacgctgttgctgccaccaaggtcgctggtgtcagaatggccaagccatcccgcgctcttcacaccccagctatgaagactactcttaagacttctaagaaggtcccagctatgcaagctaagacctacgccactcaagctccatgcatcaccaacgatgctgctgccaagagtgaaatcgatgttgaaggttggattaagaagcactacaccccatacgaaggtgatggttctttccttgctggtccaactgaaaagaccaagaagcttttcgccaaggctgaagaatacttagctaaggaacgtgccaacggtggtttatacgatgttgacccacacactccatccaccatcacttcccacaagccaggttaccttgacaaagataacgaagttatctacggttaccaaactgatgttccacttaagagagccattaagccattcggtggtgttaacatggttaagaacgctcttaaggctgttaacgttccaatggacaaggaagtcgaacacattttcactgactaccgtaagactcacaacactgctgtcttcgatctttactccaaggaaatgagatctggtcgttccaacgctatcatgaccggtttaccagatggttacggtcgtggtcgtattattggtgattaccgtcgtgttgccctttacggtactgaccgtcttatcgcccaaaagaacaaggataaggccgaactccaaaagagacaaatggacgaaccaaccatgaagctcattggtgaagttgctgatcaagttaaggctcttaagcaacttactcaaatggccaagtcctacggtattgatatctctaagccagctaagaacgccagagaagctactcaatttgtttactttggttacttaggttctatcaaggaacaagatggtgctgccatgtctcttggtcgtgttgatgccttccttgattgtttctttgaaaacgatttaaagaacggtgttatcactgaagctgaagctcaagaaatcattgataaccttatccttaagttacgtttcgctcgtcacttacgtaccccagaatacaacgacttattcgctggtgatccaacctgggttactatgtctcttggtggtatgggatctgatggtcgtaccttagttactaagacttccttccgtgtccttaacactctctacaacttaggtccagctccagaaccaaacattactgtcctctggaacaaggctcttccaaagaacttcaaggacttcgccactaaggtttctattgatacctcttccatccaatacgaatccgatgctcttatgtctgccagattcggtgatgactacggtattgcttgctgtgtctctgccatgagaattggtaaggatatgcaattcttcggtgctcgttgtaaccttgccaagcttatgctttacgtccttaaccacggtaaggatgaaagaactggtaagcaagtcggtccagactttggtccagttccagaaggtccaattccattcgactggatgtgggaaacctatgacaaggctatggactggattgccaagctctacgttaacaccatgaacgttatccacttctgtcacgaccaatactgttacgaatcccttcaaatggctcttcacgataccgatgtccgtcgtcttatggccttcggtgttgctggtctttccgttgttgctgattccttctctgctattaagtacgctaaggttaccccagtccgtgatgccaagactggtttaactgttgacttcaagattgaaggtgaattcccaaaattcggtaatgatgatgaccgtgttgatttcttcgccagaactgttactgacaagcttatcaacaagctcagaaagaccccaacctaccgtggtgctactcacactctttctattcttaccattacctctaacgtcgtttacggtaagaagactggttctactccagatggtcgtaaggctggtcaaccattcgctccaggttgtaacccaatgcacggtcgtgaattctctggtgccgttgcttctctttcttctgtcgctaaggttaactacgactcttgtatggatggtatctctaacaccttctctattgttccaaacactattggtaagtccttacaagaacgtcaaggtaacctttccggtttattagatggttacttcaccaagggtgcccaccaccttaacgttaacgttcttaagcgtgaaaccttagaagacgccatggcccacccagaaaactatccaaaccttactattcgtgtctctggttacgctgtcaactttgttaagttaactccacaacaacaaaaggaagttattgcccgtaccttccacgaaaagatgtaa

SEQ ID NO: 92 - protein, 805 aa, Piromyces sp. E2
MESLALSNVSVLANTVSVNAVAATKVAGVRMAKPSRALHTPAMKTTLKTSKKVPAMQAKTYATQAPCITNDAAAKSEIDVEGWIKKHYTPYEGDGSFLAGPTEKTKKLFAKAEEYLAKERANGGLYDVDPHTPSTITSHKPGYLDKDNEVIYGYQTDVPLKRAIKPFGGVNMVKNALKAVNVPMDKEVEHIFTDYRKTHNTAVFDLYSKEMRSGRSNAIMTGLPDGYGRGRIIGDYRRVALYGTDRLIAQKNKDKAELQKRQMDEPTMKLIGEVADQVKALKQLTQMAKSYGIDISKPAKNAREATQFVYFGYLGSIKEQDGAAMSLGRVDAFLDCFFENDLKNGVITEAEAQEIIDNLILKLRFARHLRTPEYNDLFAGDPTWVTMSLGGMGSDGRTLVTKTSFRVLNTLYNLGPAPEPNITVLWNKALPKNFKDFATKVSIDTSSIQYESDALMSARFGDDYGIACCVSAMRIGKDMQFFGARCNLAKLMLYVLNHGKDERTGKQVGPDFGPVPEGPIPFDWMWETYDKAMDWIAKLYVNTMNVIHFCHDQYCYESLQMALHDTDVRRLMAFGVAGLSVVADSFSAIKYAKVTPVRDAKTGLTVDFKIEGEFPKFGNDDDRVDFFARTVTDKLINKLRKTPTYRGATHTLSILTITSNVVYGKKTGSTPDGRKAGQPFAPGCNPMHGREFSGAVASLSSVAKVNYDSCMDGISNTFSIVPNTIGKSLQERQGNLSGLLDGYFTKGAHHLNVNVLKRETLEDAMAHPENYPNLTIRVSGYAVNFVKLTPQQQKEVIARTFHEKM

SEQ ID NO: 93 - DNA, 2414 bp, Neocallimastix frontalis
gcttagctttatccaacgtcagtgttcttgctaacactgtttctattaacgctgttgctgccaccaaggtcgctggtgtcagaatggctaaaccaactcgtgctcttcacactccagctatgaagactactcttaaggcttccaagaaggctgctgttccagtcatgcaagccaagacctacgctactgctccagttatcactaacgatgctgctgccaagagcgaaatcgatgtcgaaggttggattaagaagcactatactccatacgaaggtgatggttctttccttgctggtccaactgaaaagactaagaagcttttcgccaaggctgaagaatacttagccaaggaacgtgctaacggtggtttatacgatgttgacccacacactccatctactattacctcccacaagccaggttaccttgacaaagaaaacgaagttatttacggttaccaaactgatgttcctcttaagagagccatcaagccattcggtggtgttaacatggttaagaacgctcttaaggctgttaatgttccaatggacaaggaagtcgaacacattttctctgactaccgtaagactcacaacactgctgtcttcgatatctactctaaggaaatgagagctggtcgttccaacgctatcatgactggtttaccagatggttacggtcgtggtcgtattattggtgattaccgtcgtgttgccctttacggtactgaccgtcttatcgcccaaaaggaaaaagataaggctgaactccaaaagaagcaaatggacgaaccaaccatgaaattaattggtgaagttgctgaccaagttaaggctcttaagcaacttactcaaatggctaagtcctacggtattgatattaccaagccagccaagaacgccagagaagctactcaatttgtttacttcggttacttaggttctatcaaggaacaagatggtgctgccatgtctcttggtcgtgttgatgctttcttagattgtttctttgaaaacgatttaaagaatggtgttatcactgaatctgaagctcaagaaatcattgataaccttatcttaaagttacgtttcgctcgtcacttacgtactccagaatacaacgacttattcgctggtgatccaacctgggttactatgtctcttggtggtatgggtagtgatggtcgtaccttagttactaagacttccttccgtgttcttaacactctttacaacttaggtccagctccagaaccaaacatcactgtcctctggaacaagaaccttccaaagaacttcaaggacttcgctactaaggtttctattgatacctcttccattcaatacgaatctgatgcccttatgtccgctagattcggtgatgattacggaattgcctgctgtgtttctgccatgagaattggtaaggatatgcaattcttcggtgctcgttgtaaccttgctaagcttatgctttacgtccttaaccatggtaaggatgaaagaactggtaagcaagttggtccagacttcggtccagttccagaaggtccaattccattcgactggatgtgggaaacttatgacaaggctatggattggattgccaagctttacgttaacaccatgaacgttattcacttctgtcacgaccaatactgttacgaatctcttcaaatggctcttcacgataccgatgtccgtcgtcttatggccttcggtgttgctggtctttctgttgttgctgattccttctctgctattaagtacgctaaggttactccaatccgtgatccaaagaccggtttaactgttgacttcaaggttgaaggtgaattcccaaaattcggtaacgatgatgaccgtgttgacttcttcgccagaactgttactgacaagcttattaacaagttaagaaagactccaacctaccgtggtgctacccacactctttctattcttaccattacctctaacgtcgtttacggtaagaagaccggttctactccagatggtcgtaaggctggtcaaccattcgccccaggttgtaacccaatgcacggtcgtgaattctctggtgccgttgcttctctttcttccgttgctaaggttaactacgattcttgtatggatggtatctctaacaccttctctattgttccaaacactatcggtaagactttacaagaacgtcaaggtaacctttctggtttattagatggttacttcagcaagggtgctcaccatcttaacgttaacgttcttaagcgtgaaactttagaagatgccatggctcacccagaaaactatccaaaccttactatccgtgtttctggttatgctgtcaacttcgttaagttaactccagcccaacaaaaggaagttattgcccgtaccttccacgaaaagatgtaa

SEQ ID NO: 94 - protein, 803 aa, Neocallimastix frontalis
LALSNVSVLANTVSINAVAATKVAGVRMAKPTRALHTPAMKTTLKASKKAAVPVMQAKTYATAPVITNDAAAKSEIDVEGWIKKHYTPYEGDGSFLAGPTEKTKKLFAKAEEYLAKERANGGLYDVDPHTPSTITSHKPGYLDKENEVIYGYQTDVPLKRAIKPFGGVNMVKNALKAVNVPMDKEVEHIFSDYRKTHNTAVFDIYSKEMRAGRSNAIMTGLPDGYGRGRIIGDYRRVALYGTDRLIAQKEKDKAELQKKQMDEPTMKLIGEVADQVKALKQLTQMAKSYGIDITKPAKNAREATQFVYFGYLGSIKEQDGAAMSLGRVDAFLDCFFENDLKNGVITESEAQEIIDNLILKLRFARHLRTPEYNDLFAGDPTWVTMSLGGMGSDGRTLVTKTSFRVLNTLYNLGPAPEPNITVLWNKNLPKNFKDFATKVSIDTSSIQYESDALMSARFGDDYGIACCVSAMRIGKDMQFFGARCNLAKLMLYVLNHGKDERTGKQVGPDFGPVPEGPIPFDWMWETYDKAMDWIAKLYVNTMNVIHFCHDQYCYESLQMALHDTDVRRLMAFGVAGLSVVADSFSAIKYAKVTPIRDPKTGLTVDFKVEGEFPKFGNDDDRVDFFARTVTDKLINKLRKTPTYRGATHTLSILTITSNVVYGKKTGSTPDGRKAGQPFAPGCNPMHGREFSGAVASLSSVAKVNYDSCMDGISNTFSIVPNTIGKTLQERQGNLSGLLDGYFSKGAHHLNVNVLKRETLEDAMAHPENYPNLTIRVSGYAVNFVKLTPAQQKEVIARTFHEKM

SEQ ID NO: 95 - DNA, 2619 bp, Clostridium phytofermentans
atgacgaaaaaagtggaattacagacaactggattagtagactctctcgaagcattaacagcaaaatttagagagttaaaagaagcacaagagctctttgctacctacactcaagagcaagtagataaaatcttctttgctgctgccatggctgccaatcagcaacgtattccgttagcaaagatggctgtagaagaaacgggtatgggtattgtagaagataaagtaattaagaatcattatgctgcagagtatatttacaatgcatacaaagatacaaaaacatgtggagtggttgaagaagatcctagcttcggtatcaaaaaaattgcagagccaatcggcgtagttgcagctgtaatcccaactaccaatcctacctccactgctatctttaaaacattactttgtttaaagactcgtaacgcaatcatcatcagcccacatcctcgtgctaagaactgtaccatcgcagctgctaaggtagttttagatgctgcagttgctgcaggtgctcctgctggtataattggatggattgatgttccatcacttgaattaaccaatgaagttatgaaaaatgcagacatcatccttgcaactggtggacctggtatggtaaaggctgcttattcttctggtaaaccagcacttggtgttggcgcaggtaatacccctgttattatggatgaaagctgcgatgttcgccttgcagtaagctctattattcactctaagacatttgataacggtatgatttgtgcttccgagcaatccgtaattattagtgataagatttatgaagctgctaagaaagaattcaaggatcgtggttgccacatctgctccccagaagagactcagaagcttcgtgaaacaatcctaattaatggtgctcttaacgctaaaattgttggacaaagcgctcatacgattgcaaagcttgcaggatttgatgtagcagaagctgctaagattttaattggtgaagtagaatccgttgaactagaagaacaatttgcacacgagaaactttctccagttcttgctatgtacaaatcaaaatcctttgatgatgcagtaagcaaagctgctcgtcttgttgcagatggcggttatggccatacttcttccatctatattaatgtaggtaccggacaagaaaagattgcaaagttttctgatgctatgaagacttgccgtattcttgtaaatacaccatcctcccatggtggtatcggtgacctttataactttaaattagctccatctcttactcttggttgtggctcctggggcggtaactctgtatcagaaaacgtaggagtaaagcacttaatcaacattaagacagttgctgagaggagagaaaacatgctttggtttagagcacctgagaaagtatactttaagaagggttgtttaccagtagccctcgcagaattaaaagatgtaatgaataaaaagaaagtattcattgtaaccgatgctttcctttataaaaatggctatacaaaatgtgttactgatcagttagatgctatgggaattcagcatactacttactatgatgttgctccagatccatctttagctagtgctacagaaggtgcagaagcgatgagactcttcgagccagactgtattatcgcactcggtggtggttctgcaatggatgccggaaagattatgtgggttatgtatgaacaccctgaagtaaacttccttgaccttgcaatgcgtttcatggatattagaaagcgtgtttactccttccctaagatgggcgaaaaagcttactttatcgcagttccaacttcctccggtactggttctgaagttacaccatttgctgttattaccgatgagagaactggcgtaaaatatccacttgcagattacgaattacttcctaagatggctattattgatgccgatatgatgatgaatcaacctaagggattaacttctgcttccggtattgatgcccttacccatgcattagaggcatatgcttctatcatggctactgactatacggatggtttagcattaaaagctatgaagaatatcttcgcttaccttccaagcgcatatgaaaatggtgccgctgatccggttgcaagagaaaagatggcagatgcttctaccttagctggtatggcattcgcaaatgcattcttaggaatttgccactccatggctcataaattaggtgcattccaccacttaccacacggtgtagcaaacgcactcttaatcaacgaagtaatgcgctttaactccgttagcattcctacaaagatgggtactttctctcaataccaatacccacatgcgttagatcgttatgtagaatgtgcgaacttcttaggtattgccggaaagaacgacaatgagaaattcgaaaaccttcttaaggcaattgatgaattaaaagaaaaagttggtatcaagaaatccatcaaagaatatggcgtagacgagaaatatttcttagatactttagatgctatggttgaacaggctttcgatgatcagtgtactggtgctaacccaagatatccattaatgaaggaaatcaaggaaatctatcttaaagtgtactacggtaaataa

SEQ ID NO: 96 - protein, 872 aa, Clostridium phytofermentans
MTKKVELQTTGLVDSLEALTAKFRELKEAQELFATYTQEQVDKIFFAAAMAANQQRIPLAKMAVEETGMGIVEDKVIKNHYAAEYIYNAYKDTKTCGVVEEDPSFGIKKIAEPIGVVAAVIPTTNPTSTAIFKTLLCLKTRNAIIISPHPRAKNCTIAAAKVVLDAAVAAGAPAGIIGWIDVPSLELTNEVMKNADIILATGGPGMVKAAYSSGKPALGVGAGNTPVIMDESCDVRLAVSSIIHSKTFDNGMICASEQSVIISDKIYEAAKKEFKDRGCHICSPEETQKLRETILINGALNAKIVGQSAHTIAKLAGFDVAEAAKILIGEVESVELEEQFAHEKLSPVLAMYKSKSFDDAVSKAARLVADGGYGHTSSIYINVGTGQEKIAKFSDAMKTCRILVNTPSSHGGIGDLYNFKLAPSLTLGCGSWGGNSVSENVGVKHLINIKTVAERRENMLWFRAPEKVYFKKGCLPVALAELKDVMNKKKVFIVTDAFLYKNGYTKCVTDQLDAMGIQHTTYYDVAPDPSLASATEGAEAMRLFEPDCIIALGGGSAMDAGKIMWVMYEHPEVNFLDLAMRFMDIRKRVYSFPKMGEKAYFIAVPTSSGTGSEVTPFAVITDERTGVKYPLADYELLPKMAIIDADMMMNQPKGLTSASGIDALTHALEAYASIMATDYTDGLALKAMKNIFAYLPSAYENGAADPVAREKMADASTLAGMAFANAFLGICHSMAHKLGAFHHLPHGVANALLINEVMRFNSVSIPTKMGTFSQYQYPHALDRYVECANFLGIAGKNDNEKFENLLKAIDELKEKVGIKKSIKEYGVDEKYFLDTLDAMVEQAFDDQCTGANPRYPLMKEIKEIYLKVYYGK

SEQ ID NO: 97 - DNA, 2676 bp, Escherichia coli
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagtctgaagacccgtaacgccattatcttctccccgcacccgcgtgcaaaagatgccaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggcaacactccagttgttatcgatgaaactgctgatatcaaacgtgcagttgcatctgtactgatgtccaaaaccttcgacaacggcgtaatctgtgcttctgaacagtctgttgttgttgttgactctgtttatgacgctgtacgtgaacgttttgcaacccacggcggctatctgttgcagggtaaagagctgaaagctgttcaggatgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggcgcgtatcctgattaacaccccagcgtctcagggtggtatcggtgacctgtataacttcaaactcgcaccttccctgactctgggttgtggttcttggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaagagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatatccgctggcagactatgcgctgactccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacttgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaaggtgaaactgcagcgaagaaagaagctgctccggctaaagctgagaaaaaagcgaaaaaatccgcttaa

SEQ ID NO: 98 - protein, 891 aa, Escherichia coli
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 99 - DNA, 2865 bp, Chlamydomonas reinhardtii
  misc_feature: AdhE
atgatgtcctccagcctcgtctctggcaagagggttgccgtgccctctgctgccaagccctgtgctgctgtgccgctgccccgcgtggccggtcgccggactgctgcacgcgttgtctgcgaggctgctccctctggcgccgcccctgccagccccaaggctgaggctgctgcgcccgttgccgctgccccggccaccccccatgctgaggtgaagaaggagcgcgccccagccaccgatgaggcgctgacggagctgaaggcgctgctgaagcgcgcccagaccgcccaggcgcagtactccacctacacccaggagcaggtggacgagatcttccgcgccgccgccgaggccgccaacgccgcccgtatccccctggccaagatggccgtggaggagacccgcatgggcgtggctgaggacaaggtggtgaagaaccacttcgcctccgagttcatctacaacaagtacaagcacactaagacctgcggcgtcatcgagcacgaccccgccggcggcatccagaaggtggctgagcccgtgggcgtcattgccggtatcgtgcccaccaccaaccccacctccaccgccatcttcaagtcgctgctgtcgctcaagacccgcaacgcgctggtgctgtgcccgcacccccgcgccgccaagagcaccatcgccgccgcgcgcatcgtgcgtgacgccgccgtggccgccggcgcgccgcccaacatcatcagctgggtggagacgccctcgctgccggtgtcccaggcgctgatgcaggcgactgagatcaacctcatcctggccaccggtggcccggccatggtgcgcgccgcctactcgtccggcaacccgtcgctgggtgtgggcgccggcaacaccccggccctgattgacgagactgccgacgtggccatggccgtgtcctccatcctgctgtccaagacctttgacaacggcgtcatctgcgcctcggagcagtcggtggtggtggtggccaaggcctacgacgccgtgcgcaccgagttcgtgcgccgcggggcctacttcctgaccgaggacgacaaggtcaaggtccgcgccggtgtggttgtggacggcaagctgaaccccaacattgtgggccagtccatccccaagctggcggccctgttcggcatcaaggtgccccagggcaccaaggtgctcatcggcgaggtggagaagatcggccccgaggaggcgctgtcgcaggagaagctgtgccccatcctggccatgtaccgggcgcccgactacgaccacggcgtcaagatggcctgcgagctcatcatgtacggcggcgccggccacacctcggtgctgtacaccaacccgctcaacaacgcccacatccagcagtaccagagcgcggtcaagaccgtgcgcatcctcatcaacacccccgcctcgcagggcgccattggtgacctgtacaacttccacctggacccctccctcaccctgggctgcggcacctggggctccacctcggtgtccaccaacgtgggcccgcagcacctgctgaacatcaagaccgtcaccgcgcgccgcgagaacatgctgtggttccgcgtgccgcccaagatctacttcaagggcggctgcctggaggtggcgctgaccgatctgcgtggcaaatcgcgcgctttcattgtcacggacaagccgctttttgacatgggatacgccgacaaggtcacccacatcctggacagcattaacgtgcaccaccaggtgttctaccacgtgacccccgacccgaccctggcctgcattgaggcgggtctgaaggagatcctggagttcaagcccgatgtcatcatcgcgctgggtggtggctcgcccatggacgccgccaagatcatgtggctgatgtacgagtgccccgacacccgcttcgacggcctggccatgcgcttcatggacatccgcaagcgcgtgtacgaggtgccggagctgggcaagaaggccaccatggtgtgcatccccaccaccagtggcaccggctcggaggtgacgcccttctcggtggtcaccgacgagcgcctgggcgccaagtaccccctggccgattacgccctgacccccagcatggccattgtggacccccagctggtgctcaacatgcccaagaagctgaccgcctggggcggcattgacgcgctcacgcacgcgctggagagctacgtgtccatctgcgccaccgactacaccaagggtctgtcgcgcgaggccatcagcctgctgttcaagtacctgccccgcgcctacgccaacggctccaacgactacctggcgcgtgagaaggtgcactacgccgccacgattgccggcatggccttcgccaacgccttcctgggcatctgccactccatggcgcacaagctgggcgccgcctaccacgtgcctcacggcctggccaacgccgcgctgatcagccacgtcatccgctacaacgccaccgacatgcccgccaagcaggccgccttcccgcagtacgagtaccccaccgccaagcaggactacgccgacctggccaacatgctgggcctgggcggcaacacggtggacgagaaggtgatcaagctgattgaggcggtggaggagctcaaggccaaggtggacatcccgcccaccatcaaggagatcttcaacgaccccaaggtggacgccgacttcctggcgaacgtggacgccctggccgaggacgccttcgacgaccagtgcacgggcgccaacccgcgctacccgctcatggccgacctgaagcagctctacctggacgcccacgccgcgcccatcctgcccgtcaagaccctggagttcttctccaagatcaactaa

SEQ ID NO: 100 - protein, 954 aa, Chlamydomonas reinhardtii
  MISC_FEATURE: AdhE
MMSSSLVSGKRVAVPSAAKPCAAVPLPRVAGRRTAARVVCEAAPSGAAPASPKAEAAAPVAAAPATPHAEVKKERAPATDEALTELKALLKRAQTAQAQYSTYTQEQVDEIFRAAAEAANAARIPLAKMAVEETRMGVAEDKVVKNHFASEFIYNKYKHTKTCGVIEHDPAGGIQKVAEPVGVIAGIVPTTNPTSTAIFKSLLSLKTRNALVLCPHPRAAKSTIAAARIVRDAAVAAGAPPNIISWVETPSLPVSQALMQATEINLILATGGPAMVRAAYSSGNPSLGVGAGNTPALIDETADVAMAVSSILLSKTFDNGVICASEQSVVVVAKAYDAVRTEFVRRGAYFLTEDDKVKVRAGVVVDGKLNPNIVGQSIPKLAALFGIKVPQGTKVLIGEVEKIGPEEALSQEKLCPILAMYRAPDYDHGVKMACELIMYGGAGHTSVLYTNPLNNAHIQQYQSAVKTVRILINTPASQGAIGDLYNFHLDPSLTLGCGTWGSTSVSTNVGPQHLLNIKTVTARRENMLWFRVPPKIYFKGGCLEVALTDLRGKSRAFIVTDKPLFDMGYADKVTHILDSINVHHQVFYHVTPDPTLACIEAGLKEILEFKPDVIIALGGGSPMDAAKIMWLMYECPDTRFDGLAMRFMDIRKRVYEVPELGKKATMVCIPTTSGTGSEVTPFSVVTDERLGAKYPLADYALTPSMAIVDPQLVLNMPKKLTAWGGIDALTHALESYVSICATDYTKGLSREAISLLFKYLPRAYANGSNDYLAREKVHYAATIAGMAFANAFLGICHSMAHKLGAAYHVPHGLANAALISHVIRYNATDMPAKQAAFPQYEYPTAKQDYADLANMLGLGGNTVDEKVIKLIEAVEELKAKVDIPPTIKEIFNDPKVDADFLANVDALAEDAFDDQCTGANPRYPLMADLKQLYLDAHAAPILPVKTLEFFSKIN

SEQ ID NO: 101 - DNA, 2658 bp, Piromyces sp. E2
atgtccggattacaaatgttccaaaacctttctctttacggtagtctcgccgaaatcgatactagcgaaaagcttaacgaagctatggacaaattaactgctgcccaagaacaattcagagaatacaaccaagaacaagttgacaaaatcttcaaggctgttgctttagctgcttctcaaaaccgtgttgctttcgctaagtacgcacacgaagaaacccaaaagggtgttttcgaagataaggttatcaagaacgaattcgctgctgattacatttaccacaagtactgcaatgacaagaccgccggtatcattgaatatgatgaagccaatggtcttatggaaattgctgaaccagttggtccagttgttggtattgctccagttactaacccaacttctactatcatctacaagtctttaattgccttaaagacccgtaactgtattatcttctcaccacatccaggagctcacaaggcctctgttttcgttgttaaggtcttacaccaagctgctgttaaggctggtgccccagaaaactgtattcaaatcatcttcccaaagatggatttaactactgaattattacaccaccaaaagactcgtttcatttgggctactggtggtccaggtttagttcacgcctcttacacttctggtaagccagctcttggtggtggtccaggtaatgctccagctcttattgatgaaacttgtgatatgaacgaagctgttggttctatcgttgtttctaagactttcgattgtggtatgatctgtgccactgaaaacgctgttgtcgttgtcgaatctgtctacgaaaacttcgttgctaccatgaagaagcgtggtgcctacttcatgactccagaagaaaccaagaaggcttctaaccttcttttcggagaaggtatgagattaaatgctaaggctgttggtcaaactgccaagactttagctgaaatggccggtttcgaagtcccagaaaacaccgttgttctctgtggtgaagcttctgaagttaaattcgaagaaccaatggctcacgaaaagttaactactatcctcggtatctacaaggctaaggactttgacgatggtgtcagattatgtaaggaattagttactttcggtggtaagggtcacactgctgttctctacaccaaccaaaacaacaaggaccgtattgaaaagtaccaaaacgaagttccagccttccacatcttagttgacatgccatcttccctcggttgtattggtgatatgtacaacttccgtcttgctccagctcttaccattacttgtggtactatgggtggtggttcctcctctgataacattggtccaaagcacttacttaacatcaagcgtgttggtatgagacgcgaaaacatgctttggttcaagattccaaagtctgtctacttcaagcgtgctatcctttctgaagctttatctgacttacgtgacacccacaagcgtgctatcattattaccgatagaactatgactatgttaggtcaaactgacaagatcattaaggcttgtgaaggtcatggtatggtctgcactgtctacgataaggttgtcccagatccaactatcaagtgtattatggaaggtgttaatgaaatgaacgtcttcaagccagatttagctattgctcttggtggtggttctgctatggatgccgctaagatgatgcgtttattctacgaatacccagaccaagacttacaagatattgctactcgtttcgtcgatatccgtaagcgtgttgttggttgtccaaagcttggtagacttattaagactcttgtctgtatcccaactacctctggtactggtgccgaagttactccattcgctgtcgttacctctgaagaaggtcgtaagtacccattagtcgactacgaacttactccagatatggctattgttgatccagaattcgctgttggtatgccaaagcgtttaacttcttggactggtattgatgctcttacccacgccattgaatcttacgtttctattatggctactgacttcactagaccatactctctccgtgctgttggtcttatcttcgaatccctttcccttgcttacaacaacggtaaggatattgaagctcgtgaaaagatgcacaatgcttctgctattgctggtatggcctttgccaacgctttccttggttgttgtcactctgttgctcaccaacttggttccgtctaccacattccacacggtcttgccaacgctttaatgctttctcacatcattaagtacaacgctactgactctccagttaagatgggtaccttcccacaatacaagtacccacaagctatgcgtcactacgctgaaattgctgaactcttattaccaccaactcaagttgttaagatgactgatgttgataaggttcaatacttaattgaccgtgttgaacaattaaaggctgacgttggtattccaaagtctattaaggaaactggaatggttactgaagaagacttcttcaacaaggttgaccaagttgctatcatggccttcgatgaccaatgtactggtgctaacccacgttacccattagtttctgaattaaaacaattaatgattgatgcctggaacggtgttgtcccaaagctctaa

SEQ ID NO: 102 - protein, 885 aa, Piromyces sp. E2
MSGLQMFQNLSLYGSLAEIDTSEKLNEAMDKLTAAQEQFREYNQEQVDKIFKAVALAASQNRVAFAKYAHEETQKGVFEDKVIKNEFAADYIYHKYCNDKTAGIIEYDEANGLMEIAEPVGPVVGIAPVTNPTSTIIYKSLIALKTRNCIIFSPHPGAHKASVFVVKVLHQAAVKAGAPENCIQIIFPKMDLTTELLHHQKTRFIWATGGPGLVHASYTSGKPALGGGPGNAPALIDETCDMNEAVGSIVVSKTFDCGMICATENAVVVVESVYENFVATMKKRGAYFMTPEETKKASNLLFGEGMRLNAKAVGQTAKTLAEMAGFEVPENTVVLCGEASEVKFEEPMAHEKLTTILGIYKAKDFDDGVRLCKELVTFGGKGHTAVLYTNQNNKDRIEKYQNEVPAFHILVDMPSSLGCIGDMYNFRLAPALTITCGTMGGGSSSDNIGPKHLLNIKRVGMRRENMLWFKIPKSVYFKRAILSEALSDLRDTHKRAIIITDRTMTMLGQTDKIIKACEGHGMVCTVYDKVVPDPTIKCIMEGVNEMNVFKPDLAIALGGGSAMDAAKMMRLFYEYPDQDLQDIATRFVDIRKRVVGCPKLGRLIKTLVCIPTTSGTGAEVTPFAVVTSEEGRKYPLVDYELTPDMAIVDPEFAVGMPKRLTSWTGIDALTHAIESYVSIMATDFTRPYSLRAVGLIFESLSLAYNNGKDIEAREKMHNASAIAGMAFANAFLGCCHSVAHQLGSVYHIPHGLANALMLSHIIKYNATDSPVKMGTFPQYKYPQAMRHYAEIAELLLPPTQVVKMTDVDKVQYLIDRVEQLKADVGIPKSIKETGMVTEEDFFNKVDQVAIMAFDDQCTGANPRYPLVSELKQLMIDAWNGVVPKL

SEQ ID NO: 103 - protein, 910 aa, Bifidobacterium adolescentis
MADAKKKEEPTKPTPEEKLAAAEAEVDALVKKGLKALDEFEKLDQKQVDHIVAKASVAALNKHLVLAKMAVEETHRGLVEDKATKNIFACEHVTNYLAGQKTVGIIREDDVLGIDEIAEPVGVVAGVTPVTNPTSTAIFKSLIALKTRCPIIFGFHPGAQNCSVAAAKIVRDAAIAAGAPENCIQWIEHPSIEATGALMKHDGVATILATGGPGMVKAAYSSGKPALGVGAGNAPAYVDKNVDVVRAANDLILSKHFDYGMICATEQAIIADKDIYAPLVKELKRRKAYFVNADEKAKLEQYMFGCTAYSGQTPKLNSVVPGKSPQYIAKAAGFEIPEDATILAAECKEVGENEPLTMEKLAPVQAVLKSDNKEQAFEMCEAMLKHGAGHTAAIHTNDRDLVREYGQRMHACRIIWNSPSSLGGVGDIYNAIAPSLTLGCGSYGGNSVSGNVQAVNLINIKRIARRNNNMQWFKIPAKTYFEPNAIKYLRDMYGIEKAVIVCDKVMEQLGIVDKIIDQLRARSNRVTFRIIDYVEPEPSVETVERGAAMMREEFEPDTIIAVGGGSPMDASKIMWLLYEHPEISFSDVREKFFDIRKRAFKIPPLGKKAKLVCIPTSSGTGSEVTPFAVITDHKTGYKYPITDYALTPSVAIVDPVLARTQPRKLASDAGFDALTHAFEAYVSVYANDFTDGMALHAAKLVWDNLAESVNGEPGEEKTRAQEKMHNAATMAGMAFGSAFLGMCHGMAHTIGALCHVAHGRTNSILLPYVIRYNGSVPEEPTSWPKYNKYIAPERYQEIAKNLGVNPGKTPEEGVENLAKAVEDYRDNKLGMNKSFQECGVDEDYYWSIIDQIGMRAYEDQCAPANPRIPQIEDMKDIAIAAYYGVSQAEGHKLRVQRQGEAATEEASERA

SEQ ID NO: 104 - protein, 870 aa, Bacillus coagulans
MAIDEKVVGKSAQITEMVDSLVAKGQKALREFMELDQAQVDNIVKQMALAGLEQHMVLAKMAVEETGRGVYEDKMTKNLFATEYIYHNIKYNKTVGIIDENNNEGIVKFAEPVGVIAGVTPVTNPTSTTMFKALIAIKTRNPIIFAFHPSAQKCSSHAAKVMLDAAVKAGAPENCIQWIEKPAIEATQQLMNHSGISLILATGGSGMVKSAYSSGKPALGVGPGNVPCYIEKSADIKRAVNDLILSKTFDNGMICASEQAVIIDKEIYDNVKNELIANQCYFLNEAEKKKVEKTVINEKTQSVNSAIVGKPAYEIAKMAGVNVPEDTKILIAELTGVGPDYPLSREKLSPVLACYKANSTKQGFEFAEAMLEFGGLGHSAVIHSTNDEVIEQYGLKMKAGRIIVNSPSSQGAIGDIYNAYMPSLTLGCGTFGGNSVSTNVGVINLYNVKTMAKRRVNMQWFKIPPRVYFEKNSVQYLEKMPDISSAFIVTDPDMVRLGFVEKVLYYLRKRPDYVHCEIFSEVEPDPSIETVRKGAAAMASFQPDVIIALGGGSAMDAAKGMWLFYEHPEVDFNELKQKFMDIRKRVAKFPKLGEKAQLVCIPTTSGTGSEVTSFAVISDKKNNTKYPLADYELTPDVAIIDPQFVMTVPKSVTADTGMDVLTHAIEAYVSNMANDYTDGLAIKAIQLVHEYLPKAYANGNDALAREKMHNASTLAGMAFSNAFLGINHSLAHKIGAEFHIPHGRANAILLPHVIRYNAQKPKKFAAFPKYEHFIADQRYAEIARVLGLPASTTEEGVESLCQEIIRMCKLFNIPLSLKAAGVNRADFEKRVAIIADRAFEDQCTPANPKLPLVSELEDILRKAFEGVEAK

SEQ ID NO: 105 - protein, 867 aa, Bacillus licheniformis
MAIEEKNMKQKQNASNMIDQLVEKGLKALEEFRSFDQEQIDEIVKQMALAGLDQHMPLAKLAVEETKRGVYEDKIIKNMFATEYVYHHIKYDKTVGIINENEHDGVIEIAEPVGVIAGVTPVTNPTSTTMFKSLISIKTRNPIVFAFHPSAQKCSREAARILRDAAVKAGAPDNCIQWIETPSLDATQALMTHPNVSLILATGGAGMVKSAYSSGKPALGVGPGNVPCYIEKSANLKQAVNDLILSKTFDNGMICASEQAVIIDKGIYSDVKAEMTRNNCYFLNKTEKSKVEKLVINENTCAVNADIVGMPAFKIAEMAGIKVPQDTKILIAELEGVGPDDPLSREKLSPVLACYKVSGLEEGLKRAEEMLAFGGTGHSAVIHTNDQEAVKEFGLRMKAGRIIVNAPSSQGAIGDIYNAYMPSLTLGCGTYGGNSVSSNVGAVHLINTKKVAKRNVNMQWFKVPPKIYFEKHATQYLAKMPDISKAFIVTDPGMVKLGYVDRALHYLRRRPDYVHCEIFSDVEPDPSIETVMNGVDMMAKFQPDVIIALGGGSAMDAAKGMWMFYEHPDAEFFGLKQKFLDIRKRIVKYPKLGGKAKFVAIPTTSGTGSEVTSFSVITDKETNTKYPLADYELTPDVAIIDPQFVMTVPKHITADTGMDVLTHAIESYVSCMANDYTDGLAMKAIQLIFEYLPRAYKNGSDELAREKVHNASTIAGMAFSNAFLGINHSLAHKLGAEFQIAHGRANAILLPHVIRYNAAKPKKFTAFPKYSHFIADQRYAEIARTLGLPAKTTAEGVESLIQEIISLAKELKIPMSIKQNGVDAAAFESKVDLMAERAFEDQCTTANPKLPLVSELAEIYRSAYKGV

SEQ ID NO: 106 - protein, 866 aa, Enterococcus faecium
MMAKVMEKEKTKTIDVQAMIDGLAEKANVALKEMESFDQEKVDHIVHEMAMAALDQHMPLAKMAVEETGRGVYEDKAIKNMYASEYIWHNIKHDKTVGVINEDVQKGLIEIAEPVGVVCGVTPTTNPTSTTIFKSMIALKTRNPIVFAFHPSAQKSSAEAARVVRDAAIAAGAPENCIQWIEHPSIEATSMLMNHPGIAIVLATGGAGMVKSAYSTGKPALGVGPGNVPAYIEKTAKIKRAVNDLIVSKTFDNGMICASEQAVIVDKEIYAAVKAEFQAHQVYIVKPDELQKLEDAVMNEGKYAVNPSIVGHSAMEIAKLAGISVPKGTKMLIAELEGVGPDYPLSREKLSPVLAMIKANNTDHAFDLCEGMLNLGGLGHTAVIHSENEELHVKFGLRMKACRILVNTPSAEGGIGDIYNEMIPSLTLGCGSYGKNSVSRNVSAVNLINVKTVAKRRNNMQWFKLPPKIFFEKNSLLYLEKMENVERVMIVCDPGMVQFGYCDTVREVLSRRKNDVKIEVFSEVEPNPSTNTVYAGTKLMADFKPDTVIALGGGSAMDAAKGMWMFYEHPDTSFFGAKQKFLDIRKRTYKIDKPEKTQFVCIPTTSGTGSEVTPFAVITDSETHVKYPLADYALTPDVAIVDPQFVMSVPASVTADTGMDVLTHAIESYVSVMASDYTRGLSLQAIKLVFDYLEKSVKTPDMESREKMHNASTMAGMAFANAFLGICHSVAHKIGGEYGIPHGRTNAILLPHIIRYNAKDPQKHAMFPKYDYFRADTDYADIAKFLGLKGETTEELVEALATAVYELGNSVGINMSLKAQGVTQETLDTTVDRMAELAYEDQCTTANPKEPLISELKQIIIDAYNG

SEQ ID NO: 107 - DNA, 1311 bp, Piromyces sp.
  misc_feature: xylose isomerase
atggctaaggaatacttcccacaaatccaaaagatcaagttcgaaggtaaggactctaagaacccattggctttccactactacgacgctgaaaaggaagttatgggtaagaagatgaaggactggttgagattcgctatggcttggtggcacaccttgtgtgctgaaggtgctgaccaattcggtggtggtaccaagtctttcccatggaacgaaggtaccgacgctatcgaaatcgctaagcaaaaggttgacgctggtttcgaaatcatgcaaaagttgggtatcccatactactgtttccacgacgtcgacttggtttctgaaggtaactctatcgaagaatacgaatctaacttgaaggctgttgttgcttacttgaaggaaaagcaaaaggaaactggtatcaagttgttgtggtctaccgctaacgttttcggtcacaagagatacatgaacggtgcttctaccaacccagacttcgacgttgttgctagagctatcgttcaaatcaagaacgctatcgacgctggtatcgaattgggtgctgaaaactacgttttctggggtggtagagaaggttacatgtctttgttgaacaccgaccaaaagagagaaaaggaacacatggctaccatgttgaccatggctagagactacgctagatctaagggtttcaagggtaccttcttgatcgaaccaaagccaatggaaccaaccaagcaccaatacgacgttgacaccgaaaccgctatcggtttcttgaaggctcacaacttggacaaggacttcaaggtcaacatcgaagttaaccacgctaccttggctggtcacaccttcgaacacgaattggcttgtgctgttgacgctggtatgttgggttctatcgacgctaacagaggtgactaccaaaacggttgggacaccgaccaattcccaatcgaccaatacgaattggttcaagcctggatggaaatcatcagaggtggtggtttcgttactggtggtaccaacttcgacgctaagaccagaagaaactctaccgacttggaagacatcatcatcgctcacgtttctggtatggacgctatggctagagctttggaaaacgctgctaagttgttgcaagaatctccatacaccaagatgaagaaggaaagatacgcttctttcgactctggtatcggtaaggacttcgaagacggtaagttgaccttggaacaagtttacgaatacggtaagaagaacggtgaaccaaagcaaacctctggtaagcaagaattgtacgaagctatcgttgctatgtaccaa

SEQ ID NO: 108 - protein, 437 aa, Piromyces sp.
  misc_feature: xylose isomerase
MAKEYFPQIQKIKFEGKDSKNPLAFHYYDAEKEVMGKKMKDWLRFAMAWWHTLCAEGADQFGGGTKSFPWNEGTDAIEIAKQKVDAGFEIMQKLGIPYYCFHDVDLVSEGNSIEEYESNLKAVVAYLKEKQKETGIKLLWSTANVFGHKRYMNGASTNPDFDVVARAIVQIKNAIDAGIELGAENYVFWGGREGYMSLLNTDQKREKEHMATMLTMARDYARSKGFKGTFLIEPKPMEPTKHQYDVDTETAIGFLKAHNLDKDFKVNIEVNHATLAGHTFEHELACAVDAGMLGSIDANRGDYQNGWDTDQFPIDQYELVQAWMEIIRGGGFVTGGTNFDAKTRRNSTDLEDIIIAHVSGMDAMARALENAAKLLQESPYTKMKKERYASFDSGIGKDFEDGKLTLEQVYEYGKKNGEPKQTSGKQELYEAIVAMYQ

SEQ ID NO: 109 - DNA, 1314 bp, Bacteroides thetaiotaomicron
  misc_feature: xylose isomerase
atggctaccaaagagtttttcccaggtattgaaaagattaagttcgaaggtaaagattctaagaacccaatggctttcagatactacgacgctgaaaaggttattaacggtaaaaagatgaaggactggttgagattcgccatggcttggtggcacactttgtgtgctgaaggtggtgaccaattcggtggtggtaccaagcaatttccatggaacggtaacgctgacgctattcaagctgctaaggacaagatggatgctggtttcgagttcatgcaaaagatgggtatcgaatactactgtttccacgacgtcgacttggtttccgaaggtgcttctgttgaagaatacgaagccaacttgaaggaaattgttgcttacgccaagcaaaagcaagctgagaccggtattaagttgttgtggggtactgctaacgttttcggtcacgctagatacatgaacggtgctgctactaacccagacttcgacgttgttgccagagctgctgttcaaattaagaacgctattgacgctactattgaattgggtggtgaaaactacgttttctggggtggtagagaaggttacatgtctttgttgaacaccgaccaaaagagagaaaaggaacacttggctcaaatgttgactattgctagagactacgccagagctagaggtttcaagggtactttcttgattgaacctaagccaatggaaccaactaagcaccaatacgacgttgacactgaaactgttattggtttcttgaaggctcacggtttggacaaggacttcaaggttaacattgaagttaaccacgctactttggctggtcacactttcgaacacgaattggctgttgctgttgacaacggtatgttgggttctatcgacgctaacagaggtgactaccaaaacggttgggacactgatcaattcccaattgacaactacgaattgactcaagctatgatgcaaattattagaaacggtggtttgggtaccggtggtactaacttcgatgctaagactagaagaaactctactgacttggaagacattttcattgctcacattgctggtatggacgctatggctagagccttggaatctgctgctgctttgttggacgaatctccatacaagaagatgttggctgacagatacgcttctttcgacggtggtaaaggtaaagaatttgaagacggtaaattgactttagaagacgttgtcgcctacgccaagactaagggtgaaccaaagcaaacttctggtaaacaagaattgtacgaagctattctaaatatgtactgt

SEQ ID NO: 110 - protein, 438 aa, Bacteroides thetaiotaomicron
  misc_feature: xylose isomerase
MATKEFFPGIEKIKFEGKDSKNPMAFRYYDAEKVINGKKMKDWLRFAMAWWHTLCAEGGDQFGGGTKQFPWNGNADAIQAAKDKMDAGFEFMQKMGIEYYCFHDVDLVSEGASVEEYEANLKEIVAYAKQKQAETGIKLLWGTANVFGHARYMNGAATNPDFDVVARAAVQIKNAIDATIELGGENYVFWGGREGYMSLLNTDQKREKEHLAQMLTIARDYARARGFKGTFLIEPKPMEPTKHQYDVDTETVIGFLKAHGLDKDFKVNIEVNHATLAGHTFEHELAVAVDNGMLGSIDANRGDYQNGWDTDQFPIDNYELTQAMMQIIRNGGLGTGGTNFDAKTRRNSTDLEDIFIAHIAGMDAMARALESAAALLDESPYKKMLADRYASFDGGKGKEFEDGKLTLEDVVAYAKTKGEPKQTSGKQELYEAILNMYC

SEQ ID NO: 111 - DNA, 1485 bp, Saccharomyces cerevisiae
  misc_feature: TPS1
atgactacggataacgctaaggcgcaactgacctcgtcttcagggggtaacattattgtggtgtccaacaggcttcccgtgacaatcactaaaaacagcagtacgggacagtacgagtacgcaatgtcgtccggagggctggtcacggcgttggaagggttgaagaagacgtacactttcaagtggttcggatggcctgggctagagattcctgacgatgagaaggatcaggtgaggaaggacttgctggaaaagtttaatgccgtacccatcttcctgagcgatgaaatcgcagacttacactacaacgggttcagtaattctattctatggccgttattccattaccatcctggtgagatcaatttcgacgagaatgcgtggttggcatacaacgaggcaaaccagacgttcaccaacgagattgctaagactatgaaccataacgatttaatctgggtgcatgattaccatttgatgttggttccggaaatgttgagagtcaagattcacgagaagcaactgcaaaacgttaaggtcgggtggttcctgcacacaccattcccttcgagtgaaatttacagaatcttacctgtcagacaagagattttgaagggtgttttgagttgtgatttagtcgggttccacacatacgattatgcaagacatttcttgtcttccgtgcaaagagtgcttaacgtgaacacattgcctaatggggtggaataccagggcagattcgttaacgtaggggccttccctatcggtatcgacgtggacaagttcaccgatgggttgaaaaaggaatccgtacaaaagagaatccaacaattgaaggaaactttcaagggctgcaagatcatagttggtgtcgacaggctggattacatcaaaggtgtgcctcagaagttgcacgccatggaagtgtttctgaacgagcatccagaatggaggggcaaggttgttctggtacaggttgcagtgccaagtcgtggagatgtggaagagtaccaatatttaagatctgtggtcaatgagttggtcggtagaatcaacggtcagttcggtactgtggaattcgtccccatccatttcatgcacaagtctataccatttgaagagctgatttcgttatatgctgtgagcgatgtctgtttggtctcgtccacccgtgatggtatgaacttggtttcctacgaatatattgcttgccaagaagaaaagaaaggttccttaatcctgagtgagttcacaggtgccgcacaatccttgaatggtgctattattgtaaatccttggaacaccgatgatctttctgatgccatcaacgaggccttgactttgcccgatgtaaagaaagaagttaactgggaaaaactttacaaatacatctctaaatacacttctgccttctggggtgaaaatttcgtccatgaattatacagtacatcatcaagctcaacaagctcctctgccaccaaaaac

SEQ ID NO: 112 - protein, 495 aa, Saccharomyces cerevisiae
  misc_feature: TPS1
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 113 - DNA, 2688 bp, Saccharomyces cerevisiae
  misc_feature: TPS2
atgaccaccactgcccaagacaattctccaaagaagagacagcgtatcatcaattgtgtcacgcagctgccctacaaaatccaattgggagaaagcaacgatgactggaaaatatctgctactacaggtaacagcgcattatattcctctctagaataccttcaatttgattctaccgagtacgagcaacacgttgttggttggaccggcgaaataacaagaaccgaacgcaacctgtttactagagaagcgaaagagaaaccacaggatctggacgatgacccactatatttaacaaaagagcagatcaatgggttgactactactctacaagatcatatgaaatctgataaagaggcaaagaccgatactactcaaacagctcccgttaccaataacgttcatcccgtttggctacttagaaaaaaccagagtagatggagaaattacgcggaaaaagtaatttggccaaccttccactacatcttgaatccttcaaatgaaggtgagcaagaaaaaaactggtggtacgactacgtcaagtttaacgaagcttatgcacaaaaaatcggggaagtttacaggaagggtgacatcatctggatccatgactactacctactgctattgcctcaactactgagaatgaaatttaacgacgaatctatcattattggttatttccatcatgccccatggcctagtaatgaatattttcgctgtttgccacgtagaaaacaaatcttagatggtcttgttggggccaatagaatttgtttccaaaatgaatctttctcccgtcattttgtatcgagttgtaaaagattactcgacgcaaccgccaagaaatctaaaaactcttccgatagtgatcaatatcaagtgtctgtgtacggtggtgacgtactcgtagattctttgcctataggtgttaacacaactcaaatactgaaagatgctttcacgaaggatatagattccaaggttctttccatcaagcaagcttatcaaaacaaaaaaattattattggtagagatcgtctggattccgtcagaggcgtcgttcaaaaattaagagcttttgaaactttcttggccatgtatccagaatggcgagatcaagtggtattgatccaggtcagcagtcctactgctaacagaaattccccccaaactatcagattggaacaacaagtcaacgagttggttaattccataaattctgaatatggtaatttgaatttttctcccgtccagcattattatatgagaatccctaaagatgtatacttgtccttactaagagttgcagacttatgtttaatcacaagtgttagagacggtatgaataccactgctttggaatacgtcactgtgaaatctcacatgtcgaactttttatgctacggaaatccattgattttaagtgagttttctggctctagtaacgtattgaaagatgccattgtcgttaacccatgggattcggtggccgtggctaaatctattaacatggctttgaaattggacaaggaagaaaagtccaatttagaatcaaaattatggaaagaagttcctacaattcaagattggactaataagtttttgagttcattaaaggaacaggcgtcatctgatgatgatgtggaaaggaaaatgactccagcacttaatagacctgttcttttagaaaactacaagcaggctaagcgtagattattcctttttgattacgatggtactttgaccccaattgtcaaagacccagctgcagctattccatcggcaagactttatacaattctacaaaaattatgtgccgatcctcataatcaaatctggattatttctggtcgtgaccagaagtttttgaacaagtggttaggcggtaaacttcctcaactgggtctaagtgcggagcatggatgtttcatgaaagatgtttcttgccaagattgggtcaatttgaccgaaaaagttgatatgtcttggcaagtacgcgtcaatgaagtgatggaagaatttaccacaaggaccccaggttcattcatcgaaagaaagaaagtcgctctaacttggcattatagacgtaccgttccagaattgggtgaattccacgccaaagaactgaaagaaaaattgttatcatttactgatgacttcgatttagaggtcatggatggtaaagcaaacattgaagttcgtccaagattcgtcaacaaaggtgaaatagtcaagagactagtctggcatcaacatggcaaaccacaggacatgttgaagggaatcagtgaaaaactacctaaggatgaaatgcctgattttgtattatgtctgggtgatgacttcactgacgaagacatgtttagacagttgaataccattgaaacttgttggaaagaaaaatatcctgaccaaaaaaatcaatggggcaactacggattctatcctgtcactgtgggatctgcatccaagaaaactgtcgcaaaggctcatttaaccgatcctcagcaagtcctggagactttaggtttacttgttggtgatgtctctctcttccaaagtgctggtacggtcgacctggattccagaggtcatgtcaagaatagtgagagcagtttgaaatcaaagctagcatctaaagcttatgttatgaaaagatcggcttcttacaccggcgcaaaggtt

SEQ ID NO: 114 - protein, 896 aa, Saccharomyces cerevisiae
  misc_feature: TPS2
MTTTAQDNSPKKRQRIINCVTQLPYKIQLGESNDDWKISATTGNSALYSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSDSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEQASSDDDVERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 115 - DNA, 3294 bp, Saccharomyces cerevisiae
  misc_feature: TSL1
atggctctcatcgtggcatctttgtttttgccctaccaaccacaattcgagcttgacacctctctccctgagaactcgcaggtggactcatctctcgtgaacatccaggctatggccaatgaccaacagcaacaacgtgcgctttctaacaacatctcacaggaatcattggtcgcgccagcaccagaacaaggtgtcccaccagcaatctcaaggagtgccaccaggtcacccagtgctttcaaccgcgcctcgtctacgacaaatactgccactttagatgatcttgtctcttcggacatattcatggaaaacttgactgcgaatgcaactacctcacatacgccaacaagcaagactatacttaaaccccggaaaaatggttccgtggaacgattcttctccccttcttccaatattcccacggatcgcatcgcatcgccaatccagcatgagcatgactccggttcgagaattgcttcgccaatccaacagcaacagcaggaccccacggccaacttattaaagaacgtcaacaagtcattgttagtgcactcactgttgaacaacacctcacaaactagcctagaaggacccaacaaccacattgttaccccgaaatcgagggcgggcaacaggcctacttcggcggctacttctttagttaataggaccaaacaaggttcggcctcctctggatcttctgggtcttctgcgccaccttccattaaaaggattacgccccacttgactgcgtccgctgcaaaacagcgccccttattggctaaacagccttctaatctgaaatattcggagttagcagatatttcgtcgagtgagacgtcttcgcagcataatgagtcggacccggatgatctaactactgcccctgacgaggaatatgtttctgatttggaaatggatgacgcgaagcaggactacaaggttccaaagttcggcggctattccaataaatctaaacttaagaagtatgcgctgttaaggtcatctcaggagctgtttagccgtcttccatggtcgatcgttccctctatcaaaggtaatggcgccatgaagaacgccataaacactgcagtcttggagaatatcattccgcaccgtcatgttaagtgggtcggtaccgtcggaatcccaacggatgagattccggaaaatatccttgcgaacatctctgactctttaaaagacaagtacgactcctatcctgtccttacggacgacgtcaccttcaaagccgcatacaaaaactactgtaaacaaatcttgtggcctacgctgcattaccagattccagacaatccgaactcgaaggcttttgaagatcactcttggaagttctatagaaacttaaaccaaaggtttgcggacgcgatcgttaaaatccataagaaaggtgacaccatctggattcatgattaccatttaatgctggttccgcagatggtgagagacgtcttgccttttgccaaaataggatttaccttacatgtctcgttccccagtagtgaagtgtttaggtgtctggctcagcgtgagaagatcttagaaggcttgaccggtgcagactttgtcggcttccagacgagggagtatgcaagacatttcttacagacgtctaaccgtctgctaatggcggacgtggtacatgatgaagagctaaagtataacggcagagtcgtttctgtgaggttcaccccagttggtatagacgcctttgatttgcaatcgcaattgaaggatggaagtgtcatgcaatggcgtcaattgattcgtgaaagatggcaagggaaaaaactgattgtgtgtcgtgatcaattcgatagaattaggggtattcacaagaaattgttggcttatgaaaaatttttggtcgaaaatccagaatacgtggaaaaatcgactttaattcaaatctgtattggaagcagtaaggatgtagaactagaacgccagatcatgattgttgtggatagaatcaactcgctatccaccaatattagtatttctcaacctgtggtgtttttacatcaagatctagatttttctcagtatttagctttgagttcagaggcagatttgttcgtagtcagctctctaagggaaggtatgaacttgacatgtcacgaatttatcgtttgttctgaggacaaaaatgctcccctactgttgtcagaatttactggtagtgcatctttattgaatgatggcgctataataattaacccatgggataccaagaacttctcacaagccattctcaaggggttggagatgccattcgataagagaagaccacagtggaagaaattgatgaaagacattatcaacaacgactctacaaactggatcaaaacttctttacaagatattcatatttcgtggcaattcaatcaagaaggttccaagatcttcaaattgaatacaaaaacactgatggaagattaccagtcatctaaaaagcgtatgtttgttttcaacattgctgaaccaccttcatcgagaatgatttccatactgaatgacatgacttctaagggcaatatcgtttacataatgaactcatttccaaagcccattctggaaaatctttacagtcgggtgcaaaacattgggttgattgccgaaaatggtgcatacgttagtctgaacggtgtatggtacaacattgttgatcaagtcgattggcgtaacgatgtagccaaaattctcgaggacaaagtggaaagattacctggctcgtactacaagataaatgagtccatgatcaagttccacactgaaaatgcggaagatcaagatcgtgtagctagtgttatcggtgatgccatcacacatatcaatactgtttttgaccacaggggtattcatgcctacgtttacaaaaacgttgtttccgtacaacaagtgggactttccttatcggcagctcaatttcttttcagattctataattctgcttcagatccactggatacgagttccggccaaatcacaaatattcagacaccatctcaacaaaatccttcagatcaagaacaacaacctccagcctctcccactgtgtcgatgaaccatattgatttcgcatgtgtctctggttcatcgtctcctgtgcttgaaccattgttcaaattggtcaatgatgaagcaagtgaagggcaagtaaaagccggacacgccattgtttatggtgatgctacttctacttatgccaaagaacatgtaaatgggttaaacgaacttttcacgatcatttcaagaatcattgaagat

SEQ ID NO: 116 - protein, 1098 aa, Saccharomyces cerevisiae
  misc_feature: TSL1
MALIVASLFLPYQPQFELDTSLPENSQVDSSLVNIQAMANDQQQQRALSNNISQESLVAPAPEQGVPPAISRSATRSPSAFNRASSTTNTATLDDLVSSDIFMENLTANATTSHTPTSKTILKPRKNGSVERFFSPSSNIPTDRIASPIQHEHDSGSRIASPIQQQQQDPTANLLKNVNKSLLVHSLLNNTSQTSLEGPNNHIVTPKSRAGNRPTSAATSLVNRTKQGSASSGSSGSSAPPSIKRITPHLTASAAKQRPLLAKQPSNLKYSELADISSSETSSQHNESDPDDLTTAPDEEYVSDLEMDDAKQDYKVPKFGGYSNKSKLKKYALLRSSQELFSRLPWSIVPSIKGNGAMKNAINTAVLENIIPHRHVKWVGTVGIPTDEIPENILANISDSLKDKYDSYPVLTDDVTFKAAYKNYCKQILWPTLHYQIPDNPNSKAFEDHSWKFYRNLNQRFADAIVKIHKKGDTIWIHDYHLMLVPQMVRDVLPFAKIGFTLHVSFPSSEVFRCLAQREKILEGLTGADFVGFQTREYARHFLQTSNRLLMADVVHDEELKYNGRVVSVRFTPVGIDAFDLQSQLKDGSVMQWRQLIRERWQGKKLIVCRDQFDRIRGIHKKLLAYEKFLVENPEYVEKSTLIQICIGSSKDVELERQIMIVVDRINSLSTNISISQPVVFLHQDLDFSQYLALSSEADLFVVSSLREGMNLTCHEFIVCSEDKNAPLLLSEFTGSASLLNDGAIIINPWDTKNFSQAILKGLEMPFDKRRPQWKKLMKDIINNDSTNWIKTSLQDIHISWQFNQEGSKIFKLNTKTLMEDYQSSKKRMFVFNIAEPPSSRMISILNDMTSKGNIVYIMNSFPKPILENLYSRVQNIGLIAENGAYVSLNGVWYNIVDQVDWRNDVAKILEDKVERLPGSYYKINESMIKFHTENAEDQDRVASVIGDAITHINTVFDHRGIHAYVYKNVVSVQQVGLSLSAAQFLFRFYNSASDPLDTSSGQITNIQTPSQQNPSDQEQQPPASPTVSMNHIDFACVSGSSSPVLEPLFKLVNDEASEGQVKAGHAIVYGDATSTYAKEHVNGLNELFTIISRIIED

SEQ ID NO: 117 - DNA, 2253 bp, Saccharomyces cerevisiae
  misc_feature: NTH1
atgagtcaagttaatacaagccaaggacgggtaggccaaggccgtcaaagaagattatcatcactaagtgaattcaatgatccattttcgaacgcagaagtctactatggccccccaacagacccaagaaagcagaagcaggcaaagcccgctaagatcaaccgtacgaggactatgagtgttttcgataatgtatctcctttcaagaaaactggttttggtaaacttcaacagactaggcgtggttctgaggatgacacctattcaagtagtcaaggtaatcgtcgtttctttatcgaagatgtcgataaaacacttaatgaactactggctgctgaggataccgataaaaattatcagatcaccatcgaggataccggtccaaaagttttgaaagtcggtaccgcaaactcctatggctataagcatattaatattaggggtacgtatatgttatccaatttgttgcaggaactaactattgcgaaaagttttggtagacaccaaattttcttagatgaagctcgtataaacgaaaatcccgtcaacagattatcaagattgataaacacacagttctggaactctttgaccaggagagttgatctgaacaacgtaggcgaaattgcaaaagataccaagattgatacgccgggggcaaaaaatccaagaatctatgttccttatgattgtccagaacaatacgaattttatgttcaagcttctcaaatgcatccatctttgaaattagaagttgaatatttaccaaaaaaaataacggcagaatacgtcaaatccgtcaatgatacccccggtttactagcattggctatggaagagcacttcaatccttctactggtgaaaaaactctcattggttacccttatgctgttcctggtggtagattcaatgaattatatggttgggactcctatatgatggcactaggtctcctagaagccaacaagactgatgttgcaagaggtatggtggagcattttatttttgagattaatcactatggaaaaatattaaatgctaacagaagctactatctatgtagatcacagcccccattcttgactgaaatggccttgatagtattcaaaaaacttggtggtaggagtaatcccgatgctgtggatttgttgaaaagagctttccaagcaagcataaaagagtacaaaactgtttggaccgcatctccaaggtttgatcccgaaacaggcttatccaggtaccatcctaacggtctcggtattcctccggaaactgaaagtgatcacttcgataccgttttactaccatatgcatcgaaacacggcgttaccttagacgaatttaagcaactttataacgatggtaagataaaggagcctaaattggatgagttttttcttcatgaccgtggcgttagagaatctggacacgacactacatataggtttgagggcgtatgtgcctacctggccactattgacctgaattctcttctttacaaatacgagattgatattgcagacttcataaaggaattctgcgacgacaaatatgaagatcctttagaccattctataacaacttcagctatgtggaaagaaatggccaaaatcagacaagaaaagattaccaaatatatgtgggatgacgagtcggggtttttctttgactacaacacaaaaatcaagcacagaacgtcatacgaatccgcaactacattctgggcattatgggctggacttgccacgaaggagcaagcacagaaaatggtggagaaagcactacccaagttagagatgcttggaggtttagctgcatgtacggagcgttctcgaggcccaatttctatttcgagaccaattagacaatgggactatccatttggttgggcaccccatcaaattcttgcttgggaaggcctccgttcttatggttatttaactgtaacgaataggctagcttatagatggcttttcatgatgacaaaggcttttgtcgattataatggtattgtggttgaaaaatatgatgtcacaagaggaacagatcctcatcgtgttgaagcagaatacggtaatcaaggtgctgactttaaaggggcagctactgaaggttttggatgggtcaatgccagttacattcttggtttgaagtatatgaacagtcacgcaagaagagcgcttggtgcttgcattccaccaatatcattctttagcagtttaaggcctcaagaaagaaacctttatggacta

SEQ ID NO: 118 - protein, 751 aa, Saccharomyces cerevisiae
  misc_feature: NTH1
MSQVNTSQGRVGQGRQRRLSSLSEFNDPFSNAEVYYGPPTDPRKQKQAKPAKINRTRTMSVFDNVSPFKKTGFGKLQQTRRGSEDDTYSSSQGNRRFFIEDVDKTLNELLAAEDTDKNYQITIEDTGPKVLKVGTANSYGYKHINIRGTYMLSNLLQELTIAKSFGRHQIFLDEARINENPVNRLSRLINTQFWNSLTRRVDLNNVGEIAKDTKIDTPGAKNPRIYVPYDCPEQYEFYVQASQMHPSLKLEVEYLPKKITAEYVKSVNDTPGLLALAMEEHFNPSTGEKTLIGYPYAVPGGRFNELYGWDSYMMALGLLEANKTDVARGMVEHFIFEINHYGKILNANRSYYLCRSQPPFLTEMALIVFKKLGGRSNPDAVDLLKRAFQASIKEYKTVWTASPRFDPETGLSRYHPNGLGIPPETESDHFDTVLLPYASKHGVTLDEFKQLYNDGKIKEPKLDEFFLHDRGVRESGHDTTYRFEGVCAYLATIDLNSLLYKYEIDIADFIKEFCDDKYEDPLDHSITTSAMWKEMAKIRQEKITKYMWDDESGFFFDYNTKIKHRTSYESATTFWALWAGLATKEQAQKMVEKALPKLEMLGGLAACTERSRGPISISRPIRQWDYPFGWAPHQILAWEGLRSYGYLTVTNRLAYRWLFMMTKAFVDYNGIVVEKYDVTRGTDPHRVEAEYGNQGADFKGAATEGFGWVNASYILGLKYMNSHARRALGACIPPISFFSSLRPQERNLYGL

SEQ ID NO: 119 - DNA, 1668 bp, Bifidobacterium adolescentis
  misc_feature: PTA
atgtccttcacctccgttaccattatttcacctgaagctgctaatggtagaaacgttgttgctttgggtgttactaagactttggctgctgctggtaaaactggtgtttttagaccagctgtctgtagaaaggatactttcaccgatgttttgatcgaagcttctaatgctggtttgtccagagaacaatctgttggtgtttgtccaaaaagagccagaaacgacaaagaaggttctagagctgatatcgttgctgcttatactcaagctgttgaaactgctagaccagatgctatggttatagttggtactgatagatccgctgttaatgatccagctatgttttctttcaacgctgatgttgctgctgacttgcaatctccagttttgttggctgtatgtaccattgaaagaactccagaacaagttaagtctaccgttgaagcctctaccaaggttattgaagatgctggttctaaagttgtcggtgttttcattactggttgtgatgatactcaacctaacccattgaaggcttgttttgttgattatccagttccagtttggactttgccagctgttgattttaatgatgatgacgctatttccaaggctgatgaagcttttgctactaatgttgatgctgttgaattgaccgttgcattggaatctccatttgatgctccaactactccatacgcttttcaatatggtttgttgggtaaagctaaggccgataagaaaactatcgttttgcctgaaggtaacgaagatagaattatcaaggctgccgattacttgttggaaagagatattgtcgatttgatcatcgtcggtgacgaaaatgctattttggctagaggtcaagaattgggtttgaagtctttaggtaaggctaagttccaagctaaggatgacgaaactgttttggaacctatggttgctaagttgtgtgaattgagagctaaaaagggtatgaccgaagaacaagctagaaaacaattggccgatgattcttacttcggtactatgttggttgttatgggtatggctgatggtttggtttctggttctgttaattctactgctaacactgttagaccagccttgcaagttattaagacaaaaccaggtacttccttggtttccggtgcttttttgatgtgttttaaggatcatgctgctgtttttgctgattgcgctattaacttgaatccaaacgctgaacaattggctgaaattgctattcaatctgctgaaactgctaaggcttttggtttggaacctaaagttggtatgttgtcctattctactttgggttctggtaaaggtccagatgttgatttggttgaagaagctactactatcgttaaggataaggctccagatttggctgttgttggttctattcaatttgatgctgcttggtcaccaactgttgctgctacaaaagctaaaggtgatccagttgctggtcatgttaatgtttttgttttcccagatttgtgcgctggtaacattgcttacaaagctgttcaaagatcttctggtgctgctgcagttggtccagttttacaaggtttgaatagaccagttaacgatttgtctagaggtgctactgttcaagatatcattaacaccattgctttgaccgctattgaagcccaa

SEQ ID NO: 120 - protein, 556 aa, Bifidobacterium adolescentis
  misc_feature: PTA
MSFTSVTIISPEAANGRNVVALGVTKTLAAAGKTGVFRPAVCRKDTFTDVLIEASNAGLSREQSVGVCPKRARNDKEGSRADIVAAYTQAVETARPDAMVIVGTDRSAVNDPAMFSFNADVAADLQSPVLLAVCTIERTPEQVKSTVEASTKVIEDAGSKVVGVFITGCDDTQPNPLKACFVDYPVPVWTLPAVDFNDDDAISKADEAFATNVDAVELTVALESPFDAPTTPYAFQYGLLGKAKADKKTIVLPEGNEDRIIKAADYLLERDIVDLIIVGDENAILARGQELGLKSLGKAKFQAKDDETVLEPMVAKLCELRAKKGMTEEQARKQLADDSYFGTMLVVMGMADGLVSGSVNSTANTVRPALQVIKTKPGTSLVSGAFLMCFKDHAAVFADCAINLNPNAEQLAEIAIQSAETAKAFGLEPKVGMLSYSTLGSGKGPDVDLVEEATTIVKDKAPDLAVVGSIQFDAAWSPTVAATKAKGDPVAGHVNVFVFPDLCAGNIAYKAVQRSSGAAAVGPVLQGLNRPVNDLSRGATVQDIINTIALTAIEAQ

SEQ ID NO: 121 - DNA, 981 bp, Leuconostoc mesenteroides
  misc_feature: PTA
atggaactttttgagcaattaaaaaataaaattaccggtcaaaataagacaattgtatttccggaaggtgaagatccccgtatccagggcgcagctatcagattagcagctgataatttgatcgagccaatattgttgggggatgcacaggaaatttcaaaaactgcccaagcccataactttgatttatcgaacatagagacgattgatcctgcttcatatgatgagaatgaattggcaaaattaaatgcgacacttgtcgaaaggcgcaaagggaaaacagacgctgagacagctgccaaatggctacaaaatgttaactattttgggacaatgctggtttatactggcaaagctgacggtatggtgtcaggcgcagtacatccaactggtgatacagttcgtcctgcgttgcagatcattaaaacggcgcctggctcatcacgtatttctggtgcattcattatgcaaaaaggcgaagagcgttatgtatttgcggacgctgccattaacattgacattgattcggacacgatggctgaaattgcaatacaatcagcccacacagctcaagtgtttgatattgaaccaaaagttgcgatgctttcattttcaactaagggctccgcgaaatcacccttggtcgataaggtggcaactgccactgcattggctaagaagttagcacctgaactggcggactcaattgatggagagttacagtttgatgctgcgtttgttgaatctgttgctgccgcaaaggcgcctgattcaaaagtcgcaggtaaagcgaacacatttattttcccaagtctagaagcaggtaatattggctataaaattgcacaacgcttgggtgggtttgaagcgattggacctattttacaaggcttagcaaaacctgtttctgatttatcgcgaggagccaatgaagaggatgtttataaagtagctattattactgctgcgcaagcattataa

SEQ ID NO: 122 - protein, 326 aa, Leuconostoc mesenteroides
  misc_feature: PTA
MELFEQLKNKITGQNKTIVFPEGEDPRIQGAAIRLAADNLIEPILLGDAQEISKTAQAHNFDLSNIETIDPASYDENELAKLNATLVERRKGKTDAETAAKWLQNVNYFGTMLVYTGKADGMVSGAVHPTGDTVRPALQIIKTAPGSSRISGAFIMQKGEERYVFADAAINIDIDSDTMAEIAIQSAHTAQVFDIEPKVAMLSFSTKGSAKSPLVDKVATATALAKKLAPELADSIDGELQFDAAFVESVAAAKAPDSKVAGKANTFIFPSLEAGNIGYKIAQRLGGFEAIGPILQGLAKPVSDLSRGANEEDVYKVAIITAAQAL

SEQ ID NO: 123 - DNA, 990 bp, Oenococcus oenii
  misc_feature: PTA
atgacaaatttatttactgagttggctgataaaattaaggaaaaaaaactgagactcgtttttccggaaggcgatgattcaagagtccagggggcggccatccgtttaaaaaaagatggtttactaacgccgatattattgggagatcaggcagcggtcgaaaagacagctgcagataatcatttcgacctgagtggcatcaagcttatcgatccgcttaaattcgatgagaagcagttcaatcaattgatcgataaactggttacccgacgaaaagggaaaactgacccgcaaacggtagctatgtggctgcaggaagtaaattatttcggtaccatgcttgtttataccggcaaggccgacgcaatggtttccggtgctgttcatccaaccggcgatacggttcgtcccgctttgcagattatcaagacagctcctggtgtcagtcgtatttccggtgcttttattatgcaaaaaaatgatgaacgctatctgtttgccgattcggcaattaatatcgaacttgatgcacaaaccatggctgagattgccgttcaatcagcccatacggctaaaatatttggaatcgatccaaaagttgccatgctgagtttttcaaccaaaggatcggcaaaacatgcattggtcgataaagttgctcaggcaactaagctggcgcaggagatggcaccggatttagctgataatattgatggtgaattacaattcgatgcagcttttgtcgaatcggttgccaaattaaaagctccgggatcaaaagtggccggtcatgcgaacgttttcatttttccaagtttggaagccggaaatattggttataaaattgcccaacgcttgggtggatacgaagcaattggtcctattttgcaaggattggcagcacctgtttccgatctgtcgcgtggagcaagtcaagaagacgtatataaagttgcaattattactgctgctcaggctttaaaaaattag

SEQ ID NO: 124 - protein, 329 aa, Oenococcus oenii
  misc_feature: PTA
MTNLFTELADKIKEKKLRLVFPEGDDSRVQGAAIRLKKDGLLTPILLGDQAAVEKTAADNHFDLSGIKLIDPLKFDEKQFNQLIDKLVTRRKGKTDPQTVAMWLQEVNYFGTMLVYTGKADAMVSGAVHPTGDTVRPALQIIKTAPGVSRISGAFIMQKNDERYLFADSAINIELDAQTMAEIAVQSAHTAKIFGIDPKVAMLSFSTKGSAKHALVDKVAQATKLAQEMAPDLADNIDGELQFDAAFVESVAKLKAPGSKVAGHANVFIFPSLEAGNIGYKIAQRLGGYEAIGPILQGLAAPVSDLSRGASQEDVYKVAIITAAQALKN

SEQ ID NO: 125 - DNA, 1227 bp, Bifidobacterium adolescentis
  misc_feature: ACK
atggctaagaccgttttggttatcaactctggttcctcctctatcaaatatcaattggttgatttggaaaccggtgaaggtattgcttctggtttggttgaaaaaatcggtgaaccagttgatggtcattacaagcacgaatacaacggtgaaaaacacgaattggaagaacctatccatgatcacgaacaaggtttgaaaagagtcttgggtttcttcgatgaattcggtccaaaattggctgatgctggtatagttgctgttggtcatagagttgttcaaggtggttctatttttccaaagccagctttggttaacgataagactattggtcaagttaaggatttggctgttttggctccattgcataatggtcctgaagctaaaggtgctgaagttatgagatctttgttgccagatgttccacaaatcttcgttttcgactcttccttctttttccaattgccaaaagcttcttctacctacgctttgaacaaagaagttgcccaacaataccacattagaagatatggtgctcatggtacttcccacgaattcatttcttcagttgttccatccgttattggtaaaccagctgaaggtttaaagcaaatcgtcttgcatattggtaatggtgcttcagcttctgctgaaatttctggtaaacctgttgaaacctctatgggtttgactccattggaaggtttggttatgggtggtagaactggtgatattgatccagctgttgttttccacttgattagaaacgctcacatgtccgttgatgaattggataccttgttcaacaagagatctggtatgatgggtttaactggtttcggtgatttgagagaagttcacagattggttgaagaaggtaacgaagatgctaaattggccttggatatctacgttcatagaatcgttggttacatcggtaactacactgctcaaatgggtggtgttgatgttattacttttactgctggtgttggtgaaaacgatgatgttgttagaaagatggtttgcgataagttggctccttttggtgttaagttggacgaagaaaagaacgccactagatctaaagaacctagaattatctctaccccagattccgctgttaccatttgtgttattccaactaacgaagaattggccattgctagaaaatctgctgctattgcagaagaaggtaaggattcttacggtaacgttttctccaag

SEQ ID NO: 126 - protein, 409 aa, Bifidobacterium adolescentis
  misc_feature: ACK
MAKTVLVINSGSSSIKYQLVDLETGEGIASGLVEKIGEPVDGHYKHEYNGEKHELEEPIHDHEQGLKRVLGFFDEFGPKLADAGIVAVGHRVVQGGSIFPKPALVNDKTIGQVKDLAVLAPLHNGPEAKGAEVMRSLLPDVPQIFVFDSSFFFQLPKASSTYALNKEVAQQYHIRRYGAHGTSHEFISSVVPSVIGKPAEGLKQIVLHIGNGASASAEISGKPVETSMGLTPLEGLVMGGRTGDIDPAVVFHLIRNAHMSVDELDTLFNKRSGMMGLTGFGDLREVHRLVEEGNEDAKLALDIYVHRIVGYIGNYTAQMGGVDVITFTAGVGENDDVVRKMVCDKLAPFGVKLDEEKNATRSKEPRIISTPDSAVTICVIPTNEELAIARKSAAIAEEGKDSYGNVFSK

SEQ ID NO: 127 - DNA, 1260 bp, Leuconostoc mesenteroides
  misc_feature: ACK
atggctaaaacaatggctgttaacgcaggtagttcatcactaaagtttcaattattagagatgcctgcagaacaagtaattgcacaaggtgttatcgaacgcattggtatggacgatgcaatagtaacgattaaatacggtgcagaaatcaatgcagagcgcttggttggccattcagaagatgacgaacatattactttgtccaaagacggcaaaggtaagaagtacgaaaacgttactgcaattaaaaaccaccaacaggccattaacttcatgttgcaaaagttaacagatctgggtattattaaggactttaatgaaattactggtgtcggacatcgtgttgttgctggtggtgaatggtttaatcattccgtggtggtaacagatgaggtgctggctaaaattgatcgtcttgcagattatgcaccacttcataacccagccaatgctatgggaattcgtgctttccaaaagctcctccctgatgcattgtcagtggcggtttttgatacttctttccatcaaacaatgcctgatgaaaactttctttatgccttgccatatgaatactacacgcgttatggcgcccgcaagtatggtgctcatggtacatcgcaccgatatgttgcatcgcgtgcagccgagttgctcggtaaagatttaaaaagcttgaaattaatcacgctgcatttaggtgcaggtgcctcaattacggctattaaggatggtaagtcattagatacttctatgggattttctcccttagctggtgttgctatggcaacgcgttcaggggatgtcgatgcttcgcttgtttattatattcaagaacgcgaaggactatctaacgaagagatgttaaatatattgaacaaaaagtccggtttgcttggtatttcgacaatttcaagtgatatgcgtgacttgttagatgtccaagacactaatgagcatgctgacatggcgattagaatatttattaatcgtgttgttaaatatgtgggacagtatgttgcggaaatgggagacgttgatgctatcgtatttacagcaggaattggtgaaaactcagtcccagttcgtaaaatgattattgataaattaaactactttggtgtgaaattagatgaagaaaaaaataatgttcgcggcaaagaagttgaaatatctacgaatgactccaaggtaaaagccttgttgatcccaaccaatgaagaactaatgattgctagagatgttgaatctttgaaagcatag

SEQ ID NO: 128 - protein, 419 aa, Leuconostoc mesenteroides
  misc_feature: ACK
MAKTMAVNAGSSSLKFQLLEMPAEQVIAQGVIERIGMDDAIVTIKYGAEINAERLVGHSEDDEHITLSKDGKGKKYENVTAIKNHQQAINFMLQKLTDLGIIKDFNEITGVGHRVVAGGEWFNHSVVVTDEVLAKIDRLADYAPLHNPANAMGIRAFQKLLPDALSVAVFDTSFHQTMPDENFLYALPYEYYTRYGARKYGAHGTSHRYVASRAAELLGKDLKSLKLITLHLGAGASITAIKDGKSLDTSMGFSPLAGVAMATRSGDVDASLVYYIQEREGLSNEEMLNILNKKSGLLGISTISSDMRDLLDVQDTNEHADMAIRIFINRVVKYVGQYVAEMGDVDAIVFTAGIGENSVPVRKMIIDKLNYFGVKLDEEKNNVRGKEVEISTNDSKVKALLIPTNEELMIARDVESLKA

SEQ ID NO: 129 - DNA, 1194 bp, Oenococcus oenii
  misc_feature: ACK
atgacaaaaattttatcggtaaatgccggctcgtcttcattgaagttcaaattgcttaatatgcccgaagagagtgttatcgccgaaggactgattgaaagaatcggtggcagcctggatcaagacgataatgtcacgattaaattcaatggcgaaaaacataagagccgtcaggcttttaaaaatcacgaggatgctatcaacttgatgctttctcaatttaaaaagtttggaatcgttgataattttaatgagatcaaaggaattggccaccgtgttgttgccgggggtgaatggttcaataaatctgtattaattaacgatgaagtgctgaataaaattgaacgtttggctgcttacgctccactccataatcctgcgaacgctatgggcatcagggctttttccaaaataatccccgatgcaaccgaagttgccgtatttgatacagctttccatcaaacgatgccgaaagagaattacttgtatgcggttccttatgagtactatacgaaatacggtgttcgtaggtatggagctcacggaacttcccataaatacgtttccgaacaggctgctaaattaattgggaaacccctagaagaacttaaactgattactttgcatttaggagccggagcgtctgtaacggccattaagaatggtcgatcatttgatacctcgatgggattttcgcctttggccggattggttatggcgactcgttcaggggatgttgacgtctcattgattgattacgttaaagcaaaagaagatatttccgatcaggaaatgctaaatgttcttaaccaaaaatccggattactgggtgtgtcaacaatttcaagtgatatgcgtgatttgttggatgtttatgatactaacgatcatgctaaattggctattgatatgtttgtcggtcgtgtagttgattatatcggtcaatattattttgaattaaagggagctgatgcgcttgttttcacggccggaattggagagaattcggttccaatcaggaaaatgattatcgatcgtctggctttcttgggcattaaactcgatgaagatgcaaatgataagcatggagtcgaaacaaagattacaactgatgattccaaaatggctgcatatgtaattccaaccaatgaggaactcgaaattgctcgtgatgtacaaaatttgatgaagtaa

SEQ ID NO: 130 - protein, 397 aa, Oenococcus oenii
  misc_feature: ACK
MTKILSVNAGSSSLKFKLLNMPEESVIAEGLIERIGGSLDQDDNVTIKFNGEKHKSRQAFKNHEDAINLMLSQFKKFGIVDNFNEIKGIGHRVVAGGEWFNKSVLINDEVLNKIERLAAYAPLHNPANAMGIRAFSKIIPDATEVAVFDTAFHQTMPKENYLYAVPYEYYTKYGVRRYGAHGTSHKYVSEQAAKLIGKPLEELKLITLHLGAGASVTAIKNGRSFDTSMGFSPLAGLVMATRSGDVDVSLIDYVKAKEDISDQEMLNVLNQKSGLLGVSTISSDMRDLLDVYDTNDHAKLAIDMFVGRVVDYIGQYYFELKGADALVFTAGIGENSVPIRKMIIDRLAFLGIKLDEDANDKHGVETKITTDDSKMAAYVIPTNEELEIARDVQNLMK

SEQ ID NO: 131 - DNA, 1545 bp, Saccharomycopsis fibuligera
  misc_feature: glucoamylase
atgatcagattgaccgttttcttgaccgctgtttttgctgctgttgcttcttgtgttccagttgaattggataagagaaacaccggtcatttccaagcttattctggttataccgttgctagatctaacttcacccaatggattcatgaacaaccagctgtttcttggtactacttgttgcaaaacatcgattacccagaaggtcaattcaaatctgctaaaccaggtgttgttgttgcttctccatctacatctgaaccagattacttctaccaatggactagagataccgctattaccttcttgtccttgattgctgaagttgaagatcattctttctccaacactaccttggctaaggttgtcgaatattacatttccaacacctacaccttgcaaagagtttctaatccatccggtaacttcgattctccaaatcatgatggtttgggtgaacctaagttcaacgttgatgatactgcttatacagcttcttggggtagaccacaaaatgatggtccagctttgagagcttacgctatttctagatacttgaacgctgttgctaagcacaacaacggtaaattattattggccggtcaaaacggtattccttattcttctgcttccgatatctactggaagattattaagccagacttgcaacatgtttctactcattggtctacctctggttttgatttgtgggaagaaaatcaaggtactcatttcttcaccgctttggttcaattgaaggctttgtcttacggtattccattgtctaagacctacaatgatccaggtttcacttcttggttggaaaaacaaaaggatgccttgaactcctacattaactcttccggtttcgttaactctggtaaaaagcacatcgttgaatctccacaattgtcatctagaggtggtttggattctgctacttatattgctgccttgatcacccatgatatcggtgatgatgatacttacaccccattcaatgttgataactcctacgttttgaactccttgtattacctattggtcgacaacaagaacagatacaagatcaacggtaactacaaagctggtgctgctgttggtagatatcctgaagatgtttacaacggtgttggtacttctgaaggtaatccatggcaattggctactgcttatgctggtcaaactttttacaccttggcctacaattccttgaagaacaagaagaacttggtcatcgaaaagttgaactacgacttgtacaactccttcattgctgatttgtccaagattgattcttcctacgcttctaaggattctttgactttgacctacggttccgataactacaagaacgttatcaagtccttgttgcaattcggtgactcattcttgaaggttttgttggatcacatcgatgacaacggtcaattgactgaagaaatcaacagatacaccggttttcaagctggtgcagtttctttgacttggtcatctggttctttgttgtctgctaatagagccagaaacaagttgatcgaattattg

SEQ ID NO: 132 - protein, 515 aa, Saccharomycopsis fibuligera
  misc_feature: glucoamylase
MIRLTVFLTAVFAAVASCVPVELDKRNTGHFQAYSGYTVARSNFTQWIHEQPAVSWYYLLQNIDYPEGQFKSAKPGVVVASPSTSEPDYFYQWTRDTAITFLSLIAEVEDHSFSNTTLAKVVEYYISNTYTLQRVSNPSGNFDSPNHDGLGEPKFNVDDTAYTASWGRPQNDGPALRAYAISRYLNAVAKHNNGKLLLAGQNGIPYSSASDIYWKIIKPDLQHVSTHWSTSGFDLWEENQGTHFFTALVQLKALSYGIPLSKTYNDPGFTSWLEKQKDALNSYINSSGFVNSGKKHIVESPQLSSRGGLDSATYIAALITHDIGDDDTYTPFNVDNSYVLNSLYYLLVDNKNRYKINGNYKAGAAVGRYPEDVYNGVGTSEGNPWQLATAYAGQTFYTLAYNSLKNKKNLVIEKLNYDLYNSFIADLSKIDSSYASKDSLTLTYGSDNYKNVIKSLLQFGDSFLKVLLDHIDDNGQLTEEINRYTGFQAGAVSLTWSSGSLLSANRARNKLIELL

SEQ ID NO: 133 - DNA, 1530 bp, Bacteroides thetaiotaomicron
  misc_feature: arabinose isomerase
atgaataacgtatttgatcagtatgaagtatggttcgtaacaggagcacagctcttgtacggaggtgatgcagtaatcgcagtagacgcacactctaacgaaatggttaacggtctgaatgaatcgggcaaacttcctgttaaagtagtatacaaaggaacggccaactcttctaaagaggtggaagctgtattcaaagcagccaacaacgatgacaaatgtgtaggcgtcatcacttggatgcatactttctctcctgctaaaatgtggattcatggtctgcaacaattaaagaaaccattgctgcacctgcatactcaattcaacaaggaaattccttgggatacaatggatatggactttatgaatctgaaccagtcagctcacggcgaccgcgagttcggacatatctgtacccgtatgcgcatccgtcgcaaagtagtggtaggctactggaaagaagaagaaacattgcataagattgctgtctggatgcgtgtttgcgcaggttgggcagactctcaggatatgctgatcatccgtttcggcgatcagatgaataatgtagccgtaaccgatggtgacaaggtagaagcagaacaacgcatgggctatcatgtagattattgcccggcaagcgagctgatggaatatcacaaagatatcaaaaatgctgatgtagatgctttggtagctacttacttcaatgactacgatcatgacgcttctctggaagacaaatcaaccgaagcttatcagaaagtatggaatgctgccaaagccgagcttgctctccgtgctatcctcaaagcgaaaggcgccaaaggattcactaccaactttgacgatctgggtcagactgacggtagctatttcgatcagattccgggactggcttctcaacgcctgatggcagaaggctacggattcggtgctgaaggtgactggaaatcggctgctctttatcgtactgtatgggtaatgaatcaaggacttccgaaaggctgttcattcctcgaagactatacactgaactttgatggtgccaacagttctatcctacagtcacatatgttggagatctgtccgcttatcgcagctaacaagcctcgtctggaagtacacttcctcggcataggtatccgtaagagccagactgcccgtcttgtgttcacttcaaagacaggaacaggctgcaccgcaactgtagtggatatgggtaaccgtttccgtctgatcgtaaacgatgtagaatgtatcgaaccgaaaccacttccgaaattgccggttgcttccgcactctggattccgatgcctaacctcgaagtaggcgcaggcgcatggattctggccggtggaactcaccactcttgcttctcatacgacttgacagcagaatactgggaagattatgcagaaatcgcaggcatcgaaatggtacatatcaataaagatacgactatcagctgcttcaagaaagaactgcgcatgaatgaagtatattatatgctgaacaaagcgctttgctaa

SEQ ID NO: 134 - protein, 509 aa, Bacteroides thetaiotaomicron
  misc_feature: arabinose isomerase
MNNVFDQYEVWFVTGAQLLYGGDAVIAVDAHSNEMVNGLNESGKLPVKVVYKGTANSSKEVEAVFKAANNDDKCVGVITWMHTFSPAKMWIHGLQQLKKPLLHLHTQFNKEIPWDTMDMDFMNLNQSAHGDREFGHICTRMRIRRKVVVGYWKEEETLHKIAVWMRVCAGWADSQDMLIIRFGDQMNNVAVTDGDKVEAEQRMGYHVDYCPASELMEYHKDIKNADVDALVATYFNDYDHDASLEDKSTEAYQKVWNAAKAELALRAILKAKGAKGFTTNFDDLGQTDGSYFDQIPGLASQRLMAEGYGFGAEGDWKSAALYRTVWVMNQGLPKGCSFLEDYTLNFDGANSSILQSHMLEICPLIAANKPRLEVHFLGIGIRKSQTARLVFTSKTGTGCTATVVDMGNRFRLIVNDVECIEPKPLPKLPVASALWIPMPNLEVGAGAWILAGGTHHSCFSYDLTAEYWEDYAEIAGIEMVHINKDTTISCFKKELRMNEVYYMLNKALC

SEQ ID NO: 135 - DNA, 1596 bp, Bacteroides thetaiotaomicron
  misc_feature: araB
atgaaattagatgcaaaatcaaccatcgagacaggtaaagctatccttggcatagaactcggttctacacgaataaaagctgttctgattgaccaggaaaacaaacctatcgctcaaggcagccacacatgggaaaatcaactggtcaacggactttggacttacagcattgatgccatctggtccggactgcaagattgctacgccgacctccgctccaacgtgaagaaattatacgacacagagatcgaaacactggcagccatcggtgtcagcgccatgatgcatggttacatgcctttcaatgaaaaagaagaaatcctcgtgcctttccgcacttggagaaataccaatacaggccgtgctgcggcagaattatccgaattatttgtctataacatccctttgagatggagcatttctcatttgtaccaggctattctggacaacgaagcgcacgtcaaagacatcaagttcctgacaactcttgcaggttatgtacattggcagataacaggcgaaaaggtgttgggcattggtgacgcatcgggtatgctccccatagatccgactaccaacaactattccgccgaaatggtggccaaattcaacaatctgattgcttcgaaagaatacagttggaaactggaagacattctgcccaaagtattgtcggctggtgaaaatgccggtgtcctcacaccggaaggctgtaaaaaactcgatgcatccggtcatctgaaggcaggaataccggtctgcccaccggaaggagacgcaggcaccggcatggtagcaaccaacgccgtcaagcaacgcaccggcaacgtatcggcaggtacttcttctttctctatgatcgtattggaaaaagaattgtcgaagccatacgaaatgatcgacatggtcaccactcccgacggaagcctcgtagccatggtacattgcaacaactgtacttcggatcttaacgcatgggtcaacctgttcaaagaataccaggaacttctgggtatacctgtagatatggatgaactctatggcaaactttataacattgcccttaccggtgataccgattgcggtggtctcctctcctacaactacatttcaggcgaacctgttacgggacttgccgagggaagacctttgttcgtacgttcggccaatgacaagttcaaccttgcaaactttatgcgggctcatttgtacgcctcagtcggagttctcaagattggcaacgacatcttgttcaacgaagaaaagatcaaagtcgacagaatcacaggtcacggaggattgttcagaaccaaaggagtcggtcaaagagtacttgcagcagccatcaactcgcccatatctgttatggaaacagccggtgaaggcggtgcatggggaattgccctgctgggttcttacctggtaaacaataaaaagggtcaatctcttgccgatttcctggatgaaagtgtatttgtcagcgatgctggtgtcgaggtatcacccacacccgaagatgtagccggcttcaacacatacatcgaaagctacaaggcaggtttgcctatagaagaagcagccgtcaaattcaaataa

SEQ ID NO: 136 - protein, 531 aa, Bacteroides thetaiotaomicron
  misc_feature: araB
MKLDAKSTIETGKAILGIELGSTRIKAVLIDQENKPIAQGSHTWENQLVNGLWTYSIDAIWSGLQDCYADLRSNVKKLYDTEIETLAAIGVSAMMHGYMPFNEKEEILVPFRTWRNTNTGRAAAELSELFVYNIPLRWSISHLYQAILDNEAHVKDIKFLTTLAGYVHWQITGEKVLGIGDASGMLPIDPTTNNYSAEMVAKFNNLIASKEYSWKLEDILPKVLSAGENAGVLTPEGCKKLDASGHLKAGIPVCPPEGDAGTGMVATNAVKQRTGNVSAGTSSFSMIVLEKELSKPYEMIDMVTTPDGSLVAMVHCNNCTSDLNAWVNLFKEYQELLGIPVDMDELYGKLYNIALTGDTDCGGLLSYNYISGEPVTGLAEGRPLFVRSANDKFNLANFMRAHLYASVGVLKIGNDILFNEEKIKVDRITGHGGLFRTKGVGQRVLAAAINSPISVMETAGEGGAWGIALLGSYLVNNKKGQSLADFLDESVFVSDAGVEVSPTPEDVAGFNTYIESYKAGLPIEEAAVKFK

SEQ ID NO: 137 - DNA, 684 bp, Bacteroides thetaiotaomicron
  misc_feature: ribulose-5-phosphate epimerase
atgctggaagaactgaaagaaaaagtatttcatgccaatctcgaattggtaaagcatggattagtcatctttacatggggaaatgtttctgccatcgaccgtgaaacggaactggtagtcatcaaacccagtggagtcagttatgatgatatgaaagcggaagatatggtagtagtggacctggatggcaaagtcgtcgaaggacggctgaagccatcctcagatactcctactcacgtggtactctacaaagcattccccgaaatcggcggagtggtgcatacccactctacttatgctaccgcatgggcgcaggccggttgtgatattcccaatatcgggacaactcacgctgactatttccatgatgcaatcccctgcacagcggatatgacggaagctgaagtaaaaggtgcctatgaactggaaaccggaaacgtgatcgtaaaacgtttcgaaggcctgaaccctgtacatacaccgggagtattggtcaagaatcatggtcctttctcttggggaaaagacgcacacgatgccgtacacaatgcagtagtgatggaacaagttgccaaaatggcaagcattgcttatgccgtgaatcccaatttaacaatgaacccgctgctggtagagaaacacttcagccgcaagcatggtccgaacgcttactacggacaataa

SEQ ID NO: 138 - protein, 227 aa, Bacteroides thetaiotaomicron
  misc_feature: ribulose-5-phosphate epimerase
MLEELKEKVFHANLELVKHGLVIFTWGNVSAIDRETELVVIKPSGVSYDDMKAEDMVVVDLDGKVVEGRLKPSSDTPTHVVLYKAFPEIGGVVHTHSTYATAWAQAGCDIPNIGTTHADYFHDAIPCTADMTEAEVKGAYELETGNVIVKRFEGLNPVHTPGVLVKNHGPFSWGKDAHDAVHNAVVMEQVAKMASIAYAVNPNLTMNPLLVEKHFSRKHGPNAYYGQ

SEQ ID NO: 139 - DNA, 1707 bp, Saccharomyces cerevisiae
  misc_feature: STL1
atgaaggatttaaaattatcgaatttcaaaggcaaatttataagcagaaccagtcactggggacttacgggtaagaagttgcggtatttcatcactatcgcatctatgacgggcttctccctgtttggatacgaccaagggttgatggcaagtctaattactggtaaacagttcaactatgaatttccagcaaccaaagaaaatggcgatcatgacagacacgcaactgtagtgcagggcgctacaacctcctgttatgaattaggttgtttcgcaggttctctattcgttatgttctgcggtgaaagaattggtagaaaaccattaatcctgatgggttccgtaataaccatcattggtgccgttatttctacatgcgcatttcgtggttactgggcattaggccagtttatcatcggaagagtcgtcactggtgttggaacagggttgaatacatctactattcccgtttggcaatcagaaatgtcaaaagctgaaaatagagggttgctggtcaatttagaaggttccacaattgcttttggtactatgattgcttattggattgattttgggttgtcttataccaacagttctgttcagtggagattccccgtgtcaatgcaaatcgtttttgctctcttcctgcttgctttcatgattaaactacctgaatcgccacgttggctgatttctcaaagtcgaacagaagaagctcgctacttggtaggaacactagacgacgcggatccaaatgatgaggaagttataacagaagttgctatgcttcacgatgctgttaacaggaccaaacacgagaaacattcactgtcaagtttgttctccagaggcaggtcccaaaatcttcagagggctttgattgcagcttcaacgcaatttttccagcaatttactggttgtaacgctgccatatactactctactgtattattcaacaaaacaattaaattagactatagattatcaatgatcataggtggggtcttcgcaacaatctacgccttatctactattggttcattttttctaattgaaaagctaggtagacgtaagctgtttttattaggtgccacaggtcaagcagtttcattcacaattacatttgcatgcttggtcaaagaaaataaagaaaacgcaagaggtgctgccgtcggcttatttttgttcattacattctttggtttgtctttgctatcattaccatggatatacccaccagaaattgcatcaatgaaagttcgtgcatcaacaaacgctttctccacatgtactaattggttgtgtaactttgcggttgtcatgttcaccccaatatttattggacagtccggttggggttgctacttattttttgctgttatgaattatttatacattccagttatcttctttttctaccctgaaaccgccggaagaagtttggaggaaatcgacatcatctttgctaaagcatacgaggatggcactcaaccatggagagttgctaaccatttgcccaagttatccctacaagaagtcgaagatcatgccaatgcattgggctcttatgacgacgaaatggaaaaagaggactttggtgaagatagagtagaagacacctataaccaaattaacggcgataattcgtctagttcttcaaacatcaaaaatgaagatacagtgaacgataaagcaaattttgagggt

SEQ ID NO: 140 - protein, 569 aa, Saccharomyces cerevisiae
  misc_feature: STL1
MKDLKLSNFKGKFISRTSHWGLTGKKLRYFITIASMTGFSLFGYDQGLMASLITGKQFNYEFPATKENGDHDRHATVVQGATTSCYELGCFAGSLFVMFCGERIGRKPLILMGSVITIIGAVISTCAFRGYWALGQFIIGRVVTGVGTGLNTSTIPVWQSEMSKAENRGLLVNLEGSTIAFGTMIAYWIDFGLSYTNSSVQWRFPVSMQIVFALFLLAFMIKLPESPRWLISQSRTEEARYLVGTLDDADPNDEEVITEVAMLHDAVNRTKHEKHSLSSLFSRGRSQNLQRALIAASTQFFQQFTGCNAAIYYSTVLFNKTIKLDYRLSMIIGGVFATIYALSTIGSFFLIEKLGRRKLFLLGATGQAVSFTITFACLVKENKENARGAAVGLFLFITFFGLSLLSLPWIYPPEIASMKVRASTNAFSTCTNWLCNFAVVMFTPIFIGQSGWGCYLFFAVMNYLYIPVIFFFYPETAGRSLEEIDIIFAKAYEDGTQPWRVANHLPKLSLQEVEDHANALGSYDDEMEKEDFGEDRVEDTYNQINGDNSSSSSNIKNEDTVNDKANFEG

SEQ ID NO: 141 - DNA, 1641 bp, Candida albicans
  misc_feature: STL1
atgggtgggttcatagataatattttcaaaagaaccacaactgctggattaactggtagaaaattacgtgcagcagtcactattactgccacacttgggttttcacttttcggatatgatcaaggtttaatggccggattaatttctgccgaacaattcaattgggaattccctgctactaaagataatagtgttatccaaggtgctgttactgcatcttatgaattgggatgtttctttggtgctatttttgctttacttagaggtgatgctttaggtagaaaaccaattattttctttggtgctactattattattcttggtacaattatttccgttactccatttagaccacattggccattaggtcaatttgtggttggtagagtcatcactggtattggtaatggtatgaatactgctactattccagtgtggcaatcagaaatgtcaaaaccagaaaatagaggtaaattggtcaatttagaaggtgccgttgtggcatttggtacttttattgcttattggttagattttgggttatcttatgttgattcttcagtttcttggagattcccagttgctttccaaattttctttgccttatgggttatttttggaattattcaattacctgaatctcctcgttggttgatttctaaagatagaaaaccagaagcttttgaagtcttagctgctttaaatgatactactccagatgatgatgctattgttgctgaagctagtgttattattgacgccgttagaagaaacgctaaagtccaagctggtttcaaagatttgtttactggtggtaaaactgctcatttccaaagaatgcttattgggtcatcaacccaatttttccaacaattcactggttgtaatgcagctatttattattccactttattgttctacgaaaccgttttccatcatactaaataccgtttatcaatgattttgggtggggtgtttgctactatttatgctttagccactcttccatcattctttttaattgatactttgggtagaagaaatttgtttttaattggtgcaattggtcaagggatttcattccttatttcatttgcttgtttgattaacccaactgaacaaaatgctaaaggtgctgccgttggtatttatttgtttattgttttctttgccttcaccattttaccattaccatggatttacccaccagaaattaatccattaagaacaagaactactgcttctgccgtctccacttgtaccaattggttaaccaatttcgccgttgttatgtttactccaccatttatttctgctagtggttggggttgttatctttattttgccgttatgaatttcttgtttgttccaatcatctttttcttttatccagaaactgctggtagatcattagaagaaattgatattattttcgctaaagcttacgttgaaaaaagacaaccatggagagttgctgctactttaccaaaattatcattacaagaagttgaagatgaatctaaaagcttgggtctttatgatgatgatttcgaaaaagataatttcgaaactaaagaagatatttctgatggtactgcctcaaacagtaatggtgtttttgaaaaaccagaaaatgtttaa

SEQ ID NO: 142 - protein, 546 aa, Candida albicans
  misc_feature: STL1
MGGFIDNIFKRTTTAGLTGRKLRAAVTITATLGFSLFGYDQGLMAGLISAEQFNWEFPATKDNSVIQGAVTASYELGCFFGAIFALLRGDALGRKPIIFFGATIIILGTIISVTPFRPHWPLGQFVVGRVITGIGNGMNTATIPVWQSEMSKPENRGKLVNLEGAVVAFGTFIAYWLDFGLSYVDSSVSWRFPVAFQIFFALWVIFGIIQLPESPRWLISKDRKPEAFEVLAALNDTTPDDDAIVAEASVIIDAVRRNAKVQAGFKDLFTGGKTAHFQRMLIGSSTQFFQQFTGCNAAIYYSTLLFYETVFHHTKYRLSMILGGVFATIYALATLPSFFLIDTLGRRNLFLIGAIGQGISFLISFACLINPTEQNAKGAAVGIYLFIVFFAFTILPLPWIYPPEINPLRTRTTASAVSTCTNWLTNFAVVMFTPPFISASGWGCYLYFAVMNFLFVPIIFFFYPETAGRSLEEIDIIFAKAYVEKRQPWRVAATLPKLSLQEVEDESKSLGLYDDDFEKDNFETKEDISDGTASNSNGVFEKPENV

SEQ ID NO: 143 - DNA, 2421 bp, Aspergillus niger
  misc_feature: PHK
atgcctggagaggtcatcgacaggccaaatcccaaggctgagccttcacacatccccgatcttgtcaatcaattgcaggtcaaacttcaagagacgcgtttggaggaaactgattacaatgcccttctgaaattccgccgtgcagcggcctacattgctgctgcaatgatctttctccaagacaatgtgctgctgaagcagaatctaaggcacgaggacatcaagcccaggcttcttggccactggggaacatgtcccgggttgattcttgtatactctcacttgaactacatcatcagaaagcagaacctggatatgttgtatgtcgtcgggcctggccacggcgcgccagctattttggcctcactgtggcttgagggctctttagagaaattctacccccactactcacgagacatggatggtctccatgagctcatctcgaccttcagcacaagtgctggattaccaagccatatcaatgcggaaactcccggtgcaatccatgaaggtggtgaattgggttatgcgttagctgtctcttttggtgctgttatggacaatcccgacatgatcgtcacctgcgtggttggtgacggggaagcagaaactggtcctaccgcgacgtcctggcatgcaatcaagtacattgaccccgcagaatcaggtgccgtcctgccgattctccacgttaatggctttaagatcagcgagcgcaccatttatggctgcatggacaacaaagagctggtctccctcttcacgggttatggataccaggtgcgcattgttgagaacctggatgacatcgacgcagatctccatagctctatgatgtgggcagttgaggagatccacaagatccaaaaagcggcgcgttccggcaagccaattatgaagcctagatggccaatgattgttttgcgcacaccgaagggttggtcaggacctaaagagctccacgggtcattcatagagggatctttccactcacatcaggttcctctacctaatgcaaagaaggataaagaggagcttcaggctctgcagaaatggctgtcctcgtataatccgcacgaacttttcactgagacgggagacatcattgacgacatcaagtcagtgatccctctggaagacaccaagaagcttgggcagcgagcagaagcctacaagggctatagggcacccgatctcccagactggcgcaagtttggcgtagaaaagggctcccagcagagcgctatgaaaacaattggaaagttcattgaccaagtgtttacccaaaatcctcatggcgtccgtgtattttcgccagacgagctagagagcaacaagctggatgcagcactggcgcacacgggaaggaactttcagtgggatcaattctcgaatgccaaaggcggccgcgtcatcgaggtgctcagtgagcacctgtgccagggctttatgcagggatacacgttgacgggccgggtgggcattttcccatcgtacgaaagcttcttgggaatcatccataccatgatggtgcaatatgccaaatttaacaaaatggctcaagagacgacctggcataagccggttagtagcatcaactatatcgaaacgagtacgtgggctcgtcaggagcacaatggattctctcaccagaacccctcctttatcggagctgtgctcaggctgaagcccaccgccgcgcgagtttatctgccacctgatgctaacacatttttgaccacccttcaccactgtctcaagtccaagaattatgtcaacctcatggtaggttcaaaacagccaactcccgtgtacttgagccccgaggaagcagagagccactgccgagccggcgcatcgatctggagattctgtagtaccgacaatgggctgaacccggatgtcgtgctggttggcattggagtagaggtgatgttcgaggtcatctacgcggcggccatcctccgcaagcgttgtccagaactccgggtgcgtgtggtcaatgtgaccgacttgatgattctggagaaggaaggtctacatccacatgcattgacgaccgaagctttcgacagtctgtttggctcggaccggccgatacacttcaactaccacggatacccgggcgagctcaaaggtctgctctttgggcggccccgcctggaccgagtttcagtagaaggatacatggaggaaggaagcacgacgacgccgttcgatatgatgttgctgaaccgcgtctcacgataccacgtggcgcaggcagccgtgatcggggcgtccagacggaatgagaaggttcaagttcggcagcacgaactggtcagcgaattcggccacaacatcgtggagacacgcaaatacattctggccaaccgcaaagacccggatgatacgtatgatatgccctcctttgaataa

SEQ ID NO: 144 - protein, 806 aa, Aspergillus niger
  misc_feature: PHK
MPGEVIDRPNPKAEPSHIPDLVNQLQVKLQETRLEETDYNALLKFRRAAAYIAAAMIFLQDNVLLKQNLRHEDIKPRLLGHWGTCPGLILVYSHLNYIIRKQNLDMLYVVGPGHGAPAILASLWLEGSLEKFYPHYSRDMDGLHELISTFSTSAGLPSHINAETPGAIHEGGELGYALAVSFGAVMDNPDMIVTCVVGDGEAETGPTATSWHAIKYIDPAESGAVLPILHVNGFKISERTIYGCMDNKELVSLFTGYGYQVRIVENLDDIDADLHSSMMWAVEEIHKIQKAARSGKPIMKPRWPMIVLRTPKGWSGPKELHGSFIEGSFHSHQVPLPNAKKDKEELQALQKWLSSYNPHELFTETGDIIDDIKSVIPLEDTKKLGQRAEAYKGYRAPDLPDWRKFGVEKGSQQSAMKTIGKFIDQVFTQNPHGVRVFSPDELESNKLDAALAHTGRNFQWDQFSNAKGGRVIEVLSEHLCQGFMQGYTLTGRVGIFPSYESFLGIIHTMMVQYAKFNKMAQETTWHKPVSSINYIETSTWARQEHNGFSHQNPSFIGAVLRLKPTAARVYLPPDANTFLTTLHHCLKSKNYVNLMVGSKQPTPVYLSPEEAESHCRAGASIWRFCSTDNGLNPDVVLVGIGVEVMFEVIYAAAILRKRCPELRVRVVNVTDLMILEKEGLHPHALTTEAFDSLFGSDRPIHFNYHGYPGELKGLLFGRPRLDRVSVEGYMEEGSTTTPFDMMLLNRVSRYHVAQAAVIGASRRNEKVQVRQHELVSEFGHNIVETRKYILANRKDPDDTYDMPSFE

SEQ ID NO: 145 - DNA, 2448 bp, Neurospora crassa
  misc_feature: PHK
atgggcggaacacagatcacaattcccaacccccctcctctaccatcccacctccccgacaatgtcctcgacctggcagtccaaattgagcgcaagaacctcccagacaatgtccgcgagtcgctgcgcgcattccagcgtgcaggatgctacattgccgcctccatgatcttcttgcgcgacaatgtcctcctccaagacaaactccaagtttcgcacatcaagccccgactcctcggtcattggggaacatgccccggcctaatcctggtctggtcgcatctcaacgtcttgatccgcaaccatgacctcaacatgatttacgttatcggccccggccacggcgcccctgccgccctcgcctctctgtggctcgaaggctcccttgagcgcttctaccctggcgaatacgaccgcaatgctactggtttgcgcaacctcatcacccgtttctctgtccccggcggttttcctagccacatcaacgctgagactccaggtgcgatccatgagggtggtgagctcggatatgccctttctgtctcgttcggcgccgtcatggacaaccccgatttgatcgtcacttgtgtggtaggcgatggtgaggcggagactggcccgacagcaaccgcctggcatgctatcaagtacatcgaccccaaggagtcaggtgccgtcatccccattctgcatgtcaacggcttcaagatcagcgagcgcaccatttttgggtgcatggacgacaaggagatcgcctgcttgtttagtggctacggataccaggtgcgcattgtggaagacctggagaacattgatgatgacctgcaaagttcgctggaatgggctctagtcgagatcaagaagatccagaaggctgcgagggaggacaacaagccgattgtgaagccgagatggccgatgattgtcctcagaacgcccaagggatggactggtcccaaggaggtggagggccaaatcatcgaaggatccttccactcccatcaagtcccccttcctaaggctggtagtgatgagaagcaactccaggctctagacgagtggctttccagctacaggatcagcgagctccttgatgatgagggcaagcctactgaggccatcactcgtgtcttgcccaaggcagaaaagaggctcggtcaactcaagatcacatatgacccatacattcctctgaaactgattgactggaagcagtttggcgttcaaaagggcgtcgacgaaagctgcatgaagagtgccggcaagttcctcgacaagttgttccaagagaaccccaaaaccctccggctattctcccctgacgagctcgagtcgaacaagctcaacgccatcctggatcacacacagcgcgactttcagtgggacgagttctcgagggcacatggcggtcgcgtcatcgaggttctctccgagcacaattgccagggcttcatgcaaggatacactctcacgggccgcaccgccctcttcccctcctatgagtccttcctgggtatcgttcacaccatgatggtgcaatactccaagttcgtcaagatcgcgcgtgaagtaccctggcgtggcgacctggcctccatcaactacatcgagacttcgacctgggcgcgtcaagaacacaatggcttttcccatcagaacccctccttcattggtgctgtacttaacctgaaggccgaggccgctcgcgtttacctcccgcccgacgccaactgcttcctcagcaccgtgcatcatgtcatggacagcaagaacaagaccaacctcatcatcggctccaagcagcccacggccgtctacctctctcccgccgaagcagccgaccactgtcgccagggtgcctcgatctggcatttcgcctcttcctccgaccccaactcatccgcaggagagtcggtacaagacccagatgtagtcctcgtcggcatcggcgtcgaagttacttttgaggtgattaaagctgctgaactcttgcgctccattgcgcccgccctcaagatccgcgtcgtcaatgtgacggatctgatgattctcatcgaagagtccaagcacccgcatgccctggccaaggccaagttcatcgaaatgttcaccgccgacagaccggtgttgttcaactaccatggctacccgacggaactgcagggtctcttgtttgggagggaaaaggcggagcgcatggatgtcgagggttaccaagaagagggaagcacgaccacgccgtttgatatgatgttgaggaaccgggtcagtcggttcgatgtggcgagctgggcgctgaagaggggtgcggagaggaatgcggaggtgaagaatgatttggaaggtttgttgggtgacgtggataggagagtgaaggaggttcgtgagtttattgggaatgaaggaaaggatcccgatgatatctaccaactgcccaagttcgagtag

SEQ ID NO: 146 - protein, 815 aa, Neurospora crassa
  misc_feature: PHK
MGGTQITIPNPPPLPSHLPDNVLDLAVQIERKNLPDNVRESLRAFQRAGCYIAASMIFLRDNVLLQDKLQVSHIKPRLLGHWGTCPGLILVWSHLNVLIRNHDLNMIYVIGPGHGAPAALASLWLEGSLERFYPGEYDRNATGLRNLITRFSVPGGFPSHINAETPGAIHEGGELGYALSVSFGAVMDNPDLIVTCVVGDGEAETGPTATAWHAIKYIDPKESGAVIPILHVNGFKISERTIFGCMDDKEIACLFSGYGYQVRIVEDLENIDDDLQSSLEWALVEIKKIQKAAREDNKPIVKPRWPMIVLRTPKGWTGPKEVEGQIIEGSFHSHQVPLPKAGSDEKQLQALDEWLSSYRISELLDDEGKPTEAITRVLPKAEKRLGQLKITYDPYIPLKLIDWKQFGVQKGVDESCMKSAGKFLDKLFQENPKTLRLFSPDELESNKLNAILDHTQRDFQWDEFSRAHGGRVIEVLSEHNCQGFMQGYTLTGRTALFPSYESFLGIVHTMMVQYSKFVKIAREVPWRGDLASINYIETSTWARQEHNGFSHQNPSFIGAVLNLKAEAARVYLPPDANCFLSTVHHVMDSKNKTNLIIGSKQPTAVYLSPAEAADHCRQGASIWHFASSSDPNSSAGESVQDPDVVLVGIGVEVTFEVIKAAELLRSIAPALKIRVVNVTDLMILIEESKHPHALAKAKFIEMFTADRPVLFNYHGYPTELQGLLFGREKAERMDVEGYQEEGSTTTPFDMMLRNRVSRFDVASWALKRGAERNAEVKNDLEGLLGDVDRRVKEVREFIGNEGKDPDDIYQLPKFE

SEQ ID NO: 147 - DNA, 2382 bp, Lactobacillus casei
  misc_feature: PHK
atggatacaaaagtaaagactgttgattactcatccaaggaatactttgacaagatgaccgcttattggcgggcagccaactatatttcagttggtcaactttatttgaaggacaacccgctgctggaacggccactgaagagcgaagacgtcaagccgcatccgatcggccattggggcacgattgctgggcagaacttcatttatacccacttgaaccgggtgatcaataagtatgacttgaacatgttttatattgaaggcccgggtcatggcggccaagtgatggtttccaattcctatctagacggttcgtattcggagatttatccgcgtgtgtcgcaggataaagaaggcatgaagaacctatttacgcagttctcatggccaggtggcgttgcttcacatgcgagtgcacaaacgccaggttccatccatgaaggtggcgaattaggttatgctttgagtcacgcaaccggcgcgattcttgataatcctgaggtcatcgcggcggttgtcacgggtgatggtgaaactgaaaccggcccattggctgcatcatggttcagcaatacgttcattaacccaatcacggatggcgcgattttaccgattgtgcatatgaacgggtttaagatttccaacccaactatcttgtcacgtaagtcagatgaagatctagacaaatacttcagtggtatgggttggaagccattcttcgttgaaggcgatgatccagagaagctgaatccggaaatggctaaagttttggatgaagcaattgaagacattaaggccattcagaaacatgcacgtgagactggcgacaccacgatgccacactggccagtgattattttccggtcaccaaagggctggacaggcccgaagagttggaatggcgaaccaatcgaaggttccttccgtgcgcaccagattccgattcctgtcgacgctgaagacatggaacacgctgattccttggcaggctggctgaagtcctaccatccagaggaactgttcgatgaaaacggcaagttgatccctgaattggctgcattgccgccaaagggtgagcagcggatggctgctaacccaattacgaacggtgggattgatccgaagccgttggtattgccagattatcgcaagtatgcgctggacaacaaggaacacggcaagcagattaagcaagacatgatcgtgtggtctgattatctgcgtgatttgatcaagctgaatccgcataatttccggatctttggccctgacgaaaccatgagtaaccggttgtatagcttgtttgaagtgaccaaccgtcaatggctggaaccaatcaaggaaccggctgaccaatatttggcaccggctggccggattattgactcgcagttgtccgaacatcaggcggaaggctttaacgaaggctacacgttgaccggccgtcatggcttattcaccagttacgaagctttcctccgggtcgtcgattccatgctcactcagcacttcaagtggattcggaaggcacatgaagaaccatggcataaggcttatccaagtctgaacgtggtctcaacatcgacttccttccagcaggatcacaatgggtacacccatcaggacccaggtattttgacacacatggctgaaaagaaggctgaatacattcgcgagtatctaccagctgatgccaacagcttgctggccatttctccgaagttgttcagctcacaaaataccgtgaacgtgctcatcacatccaagcagccgcggccacagttctatagcattgatgaagccactgttttggctaattccggcttgaagcggattgattgggcttccaatgatgatggcgtcgaaccagatgttgtcattgccgctgccggaaccgaaccaaacatggaaagtcttgctgccattaacttgctgcacgacgccttcccagatttgaagattcgcttcattaacgtggttgacctgctgaagctgcgcagtccggaaatcgatccgcgcggtttgagtgatgctgaattcaacagctacttcaccaccgacaaaccgatcctcttcgcttatcatggctttgaagggttgattcgcgacatcttcttcactcgcccgaatcgcaatgtgctgattcacggctatcgtgaagaaggtgacattaccacaccatttgacatgcgggtactcaacgaacttgaccgttaccacttggccaaggatgttattcagcatgtgccagcctacgctgaaaaggctgccgcgtttgttcagaagatggatgataccttgcaatatcatcatgacttcatccgcgcaaacggcgatgatattccagaagttcaggaatggacctggaaaccaatcaagtaa

SEQ ID NO: 148 - protein, 793 aa, Lactobacillus casei
  misc_feature: PHK
MDTKVKTVDYSSKEYFDKMTAYWRAANYISVGQLYLKDNPLLERPLKSEDVKPHPIGHWGTIAGQNFIYTHLNRVINKYDLNMFYIEGPGHGGQVMVSNSYLDGSYSEIYPRVSQDKEGMKNLFTQFSWPGGVASHASAQTPGSIHEGGELGYALSHATGAILDNPEVIAAVVTGDGETETGPLAASWFSNTFINPITDGAILPIVHMNGFKISNPTILSRKSDEDLDKYFSGMGWKPFFVEGDDPEKLNPEMAKVLDEAIEDIKAIQKHARETGDTTMPHWPVIIFRSPKGWTGPKSWNGEPIEGSFRAHQIPIPVDAEDMEHADSLAGWLKSYHPEELFDENGKLIPELAALPPKGEQRMAANPITNGGIDPKPLVLPDYRKYALDNKEHGKQIKQDMIVWSDYLRDLIKLNPHNFRIFGPDETMSNRLYSLFEVTNRQWLEPIKEPADQYLAPAGRIIDSQLSEHQAEGFNEGYTLTGRHGLFTSYEAFLRVVDSMLTQHFKWIRKAHEEPWHKAYPSLNVVSTSTSFQQDHNGYTHQDPGILTHMAEKKAEYIREYLPADANSLLAISPKLFSSQNTVNVLITSKQPRPQFYSIDEATVLANSGLKRIDWASNDDGVEPDVVIAAAGTEPNMESLAAINLLHDAFPDLKIRFINVVDLLKLRSPEIDPRGLSDAEFNSYFTTDKPILFAYHGFEGLIRDIFFTRPNRNVLIHGYREEGDITTPFDMRVLNELDRYHLAKDVIQHVPAYAEKAAAFVQKMDDTLQYHHDFIRANGDDIPEVQEWTWKPIK

SEQ ID NO: 149 - DNA, 2367 bp, Lactobacillus plantarum
  misc_feature: PHK1
atgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataa

SEQ ID NO: 150 - protein, 788 aa, Lactobacillus plantarum [sequence omitted]

SEQ ID NO: 151 - DNA, 2391 bp, Lactobacillus plantarum
  misc_feature: PHK2
atgagtgaagcaattaaatccaaaacagttgattactcttctgatgaatatctaaaacgcgttgatgaatattggcgtgctgctaactacatctcagttggtcaactctatctactaaataacccgttacttcgggaaccactaaaggcgaccgacgtgaaagttcatccaatcggccattggggcacgattgctggtcaaaactttatttatgcccatttaaaccgggcaatcaataagtatggcttgaacatgttctacattgaaggccctggtcatggtggtcaagtaatggtttctaactcctacttagatggcacctatacggaaacgtatcctaaaatcacccaagacaaagctgggatgaaacgcttattcaagcaattctcattcccaggcggggttgcttcccatgccgatcctaagacgcctggttcgatccatgaaggtggcgaacttggctactcaatcctgcatggtgctggtgcagtattagataatccaggtttaattgccgctaccgttgttggtgatggtgaatctgaaactgggccattggcaacttcttggcaagttaacaagttccttaacccaattacagacgggacagtcttgccaatcttgaacttaaacggcttcaagatttctaatccaacagttctttcacgtgaatcacatgaagaacttgaagactactttaaaggtctaggctgggatccacactttgttgaaggtacagaccctgccaagatgcacaaaattatggctgaagaattggataaagtcattgaagaaatccacgcaattcgtaagaacgccaaggataacaatgatgaatctcgtcctaagtggccaatgattgttttccgggcacctaagggctggaccggtcctaagagttgggacggcgaaccaattgaaggttcattccgggctcaccaaattccaattcctgtcgatcgcaatcacatggaacacgccgacaaattagttgactggctcaaatcatacaaaccagaagaattatttgatgaaaatggtactttaaaaccagaaattgccgcaatcatccctgaaggccaagctcgtatggctgctaaccccgttactaacggcggtaagttaactaaagacttaattacaccaaatatcgatgattatgctttggacaacaagagtcacggtaaggaagacggttcagacatgactgaacttggtaagtatatccgtgatttaattgagttgaacaaagacaacaagaacttccgtggctggggtcctgacgaaaccttatctaacaaactaggcgctgcttttgaagataccaaacgtcagtggatggaaccaatccacgaacctaatgatgctttgttagcacctcaaggccggattattgactccatgttgtcagaacacatggatgaagggatgttggaagcttacaatttaaccggacgttacggtttcttcgcaagttatgaatcattcctgcgcgttgtggattcaatgttaacccaacacttcaagtggttacggaattctcacgaagaaaccccttggcgggctgatgtaccttcactgaatgtgattgcatcatcaacagccttccaacaagatcacaatggttactctcaccaagatccaggtatcatttcacacttggctgaaaagaagaccgaatacgttcgtgcctatcttccaggtgatgccaatactttgattgcaacctttgataaggctatccaaagcaaacaattgattaatttaatcattgccagcaagcaccctcgtccacaatggttcacaatggacgaagctaagcgcttagttcgtgatggccttggtgttgttgattgggcaagcactgatcatggtgaagaacccgacgttgtcttcgcaactgccggctctgaaccaacgactgaaagcttagctgccgtatcaatcttgcatgcacgcttccctgaaatgaagattcgcttcattaacgttgttgatcttctgaagctgaagaaagacgaccctcgtggtttatcagatgctgaatttgatgctttcttcactaaggacaaaccagttatctttgcttatcatgcatacgacgacttagtaaagaccatcttcttcgatcgccataaccataacttacacgttcatggttaccgcgaagaaggcgacattacaacgccattcgacatgcgtgttcgcaacgaactcgatcgtttccacttagtcaaagctgccttattagcaacgccagcttatgccgaaaaaggtgcccatgtcattcaagagatgaacagcattttagacaagcatcatgactatatccgtgctgaaggtaccgatattccagaagttgaaaactggaaatggactgcattgaagtag

SEQ ID NO: 152 - protein, 796 aa, Lactobacillus plantarum [sequence omitted]

SEQ ID NO: 153 - DNA, 2478 bp, Bifidobacterium adolescentis
  misc_feature: PHK
atgacgagtcctgttattggcaccccttggaagaagctgaacgctccggtttccgaggaagctatcgaaggcgtggataagtactggcgcgcagccaactacctctccatcggccagatctatctgcgtagcaacccgctgatgaaggagcctttcacccgcgaagacgtcaagcaccgtctggtcggtcactggggcaccaccccgggcctgaacttcctcatcggccacatcaaccgtctcattgctgatcaccagcagaacactgtgatcatcatgggcccgggccacggcggcccggctggtaccgctcagtcctacctggacggcacctacaccgagtacttcccgaacatcaccaaggatgaggctggcctgcagaagttcttccgccagttctcctacccgggtggcatcccgtcccactacgctccggagaccccgggctccatccacgaaggcggcgagctgggttacgccctgtcccacgcctacggcgctgtgatgaacaacccgagcctgttcgtcccggccatcgtcggcgacggtgaagctgagaccggcccgctggccaccggctggcagtccaacaagctcatcaacccgcgcaccgacggtatcgtgctgccgatcctgcacctcaacggctacaagatcgccaacccgaccatcctgtcccgcatctccgacgaagagctccacgagttcttccacggcatgggctatgagccgtacgagttcgtcgctggcttcgacaacgaggatcacctgtcgatccaccgtcgtttcgccgagctgttcgagaccgtcttcgacgagatctgcgacatcaaggccgccgctcagaccgacgacatgactcgtccgttctacccgatgatcatcttccgtaccccgaagggctggacctgcccgaagttcatcgacggcaagaagaccgagggctcctggcgttcccaccaggtgccgctggcttccgcccgcgataccgaggcccacttcgaggtcctcaagaactggctcgagtcctacaagccggaagagctgttcgacgagaacggcgccgtgaagccggaagtcaccgccttcatgccgaccggcgaactgcgcatcggtgagaacccgaacgccaacggtggccgcatccgcgaagagctgaagctgccgaagctggaagactacgaggtcaaggaagtcgccgagtacggccacggctggggccagctcgaggccacccgtcgtctgggcgtctacacccgcgacatcatcaagaacaacccggactccttccgtatcttcggaccggatgagaccgcttccaaccgtctgcaggccgcttacgacgtcaccaacaagcagtgggacgccggctacctgtccgctcaggtcgacgagcacatggctgtcaccggccaggtcaccgagcagctttccgagcaccagatggaaggcttcctcgagggctacctgctgaccggccgtcacggcatctggagctcctatgagtccttcgtgcacgtgatcgactccatgctgaaccagcacgccaagtggctcgaggctaccgtccgcgagattccgtggcgcaagccgatctcctccatgaacctgctcgtctcctcccacgtgtggcgtcaggatcacaacggcttctcccaccaggatccgggtgtcacctccgtcctgctgaacaagtgcttcaacaacgatcacgtgatcggcatctacttcccggtggattccaacatgctgctcgctgtggctgagaagtgctacaagtccaccaacaagatcaacgccatcatcgccggcaagcagccggccgccacctggctgaccctggacgaagctcgcgccgagctcgagaagggtgctgccgagtggaagtgggcttccaacgtgaagtccaacgatgaggctcagatcgtgctcgccgccaccggtgatgttccgactcaggaaatcatggccgctgccgacaagctggacgccatgggcatcaagttcaaggtcgtcaacgtggttgacctggtcaagctgcagtccgccaaggagaacaacgaggccctctccgatgaggagttcgctgagctgttcaccgaggacaagccggtcctgttcgcttaccactcctatgcccgcgatgtgcgtggtctgatctacgatcgcccgaaccacgacaacttcaacgttcacggctacgaggagcagggctccaccaccaccccgtacgacatggttcgcgtgaacaacatcgatcgctacgagctccaggctgaagctctgcgcatgattgacgctgacaagtacgccgacaagatcaacgagctcgaggccttccgtcaggaagccttccagttcgctgtcgacaacggctacgatcacccggattacaccgactgggtctactccggtgtcaacaccaacaagcagggtgctatctccgctaccgccgcaaccgctggcgataacgagtga

SEQ ID NO: 154 - protein, 825 aa, Bifidobacterium adolescentis
  misc_feature: PHK
MTSPVIGTPWKKLNAPVSEEAIEGVDKYWRAANYLSIGQIYLRSNPLMKEPFTREDVKHRLVGHWGTTPGLNFLIGHINRLIADHQQNTVIIMGPGHGGPAGTAQSYLDGTYTEYFPNITKDEAGLQKFFRQFSYPGGIPSHYAPETPGSIHEGGELGYALSHAYGAVMNNPSLFVPAIVGDGEAETGPLATGWQSNKLINPRTDGIVLPILHLNGYKIANPTILSRISDEELHEFFHGMGYEPYEFVAGFDNEDHLSIHRRFAELFETVFDEICDIKAAAQTDDMTRPFYPMIIFRTPKGWTCPKFIDGKKTEGSWRSHQVPLASARDTEAHFEVLKNWLESYKPEELFDENGAVKPEVTAFMPTGELRIGENPNANGGRIREELKLPKLEDYEVKEVAEYGHGWGQLEATRRLGVYTRDIIKNNPDSFRIFGPDETASNRLQAAYDVTNKQWDAGYLSAQVDEHMAVTGQVTEQLSEHQMEGFLEGYLLTGRHGIWSSYESFVHVIDSMLNQHAKWLEATVREIPWRKPISSMNLLVSSHVWRQDHNGFSHQDPGVTSVLLNKCFNNDHVIGIYFPVDSNMLLAVAEKCYKSTNKINAIIAGKQPAATWLTLDEARAELEKGAAEWKWASNVKSNDEAQIVLAATGDVPTQEIMAAADKLDAMGIKFKVVNVVDLVKLQSAKENNEALSDEEFAELFTEDKPVLFAYHSYARDVRGLIYDRPNHDNFNVHGYEEQGSTTTPYDMVRVNNIDRYELQAEALRMIDADKYADKINELEAFRQEAFQFAVDNGYDHPDYTDWVYSGVNTNKQGAISATAATAGDNE

SEQ ID NO: 155 - DNA, 2406 bp, Bifidobacterium bifidum
  misc_feature: PHK
atggacaagtactggcgcgttgccaactacctttccatcggccagatctatctgcggagcaacccgctgatgaaggaacccttcacccgtgaagacgtgaagcaccgtctggtggggcactggggcaccacccctggcctgaacttcctcatcggccacatcaaccgcttcatcgctgaccacggccagaacaccgtgttcatcatgggcccgggccacggtggccccgccggtacctcccagtcctacctggacggcacctacaccgagacgtaccccaacattaccaaggatgaggctggcctgcagaagttcttccgccagttctcctacccgggcggcatcccctcccacttcgctccggaaaccccgggctccatccacgagggtggcgagctgggttacgccctgtcccacgcttatggcgcgatcatggacaacccgagcctgttcgttccctgcatcgtcggcgatggtgaggccgagaccggcccgctggccaccggctggcagtccaacaagctcgtgaacccgcgcaccgacggtatcgtgctgccgatcctgcaccttaacggctacaagatcgccaacccgaccatcctgtcgcgcatctccgacgaagagctccacgagttcttccacggcatgggctacgagccctatgagttcgtcgccggcttcgacgatgaggaccacatgtccatccaccgtcgcttcgccgagctgttcgagtccgtgtgggacgagatctgcgacatcaaggccgcggcgaacacggacaacatgcaccgtccgttctacccgatgatcatcttccgcaccccgaagggctggacctgcccgaagtacatcgacggcaagaagaccgagggctcctggcgcgcccaccaggtgccgctggcttccgcccgcgacaccgaggcccacttcgaggtcctcaagaactggctggagtcctacaagccggaagagctgttcgacgccaacggtgccgtcaaggacgacgtcctggccttcatgccgaagggcgagctgcgcatcggcgccaacccgaacgccaacggtggcgtgatccgcagggatctcgtgctgccggcgctcgaggactacgaggtcaaggaagtcaaggagttcggacacggctggggccagctcgaggccacccgtcgtctgggcgtctacacccgcgacatcatcaagaacaacatgcacgacttccgcatcttcggaccggatgagaccgcttccaaccgtctgcaggcttcctacgaggtcaccaacaagcagtgggacgccggctacatctccgacgaggttgacgagcacatgcacgtctccggccaggtcgtcgagcagctgtccgagcaccagatggaaggcttcctcgaggcctacctgctgaccggccgtcacggcatctggagctcctacgagtcctttgtgcacgtgatcgactccatgctgaaccagcacgccaagtggcttgaggctaccgtccgcgagattccgtggcgcaagccgattgcctccatgaacctgctggtctcctcgcacgtgtggcgtcaggatcacaacggtttctcgcaccaggacccgggtgtcacctccgtcctgctgaacaagtgcttccacaacgatcacgtcatcggcatctacttcgcgaccgacgcgaacatgctgctggccatcgccgagaagtgctacaagtccaccaacaagatcaacgccatcatcgccggcaagcagccggccgccacctggctgaccctggacgaggctcgtgccgagctcgccaagggtgccgccgcttgggattgggcttccaccgcgaagaccaacgatgaggctcaggtcgtgctcgccgccgccggcgacgtcccgacccaggagatcatggccgcttccgacaagttgaaggccctgggcatcaagttcaaggtcgtcaacgtggctgatctgctctccctgcagtctgccaaggagaacgacgaagcgctgaccgacgaggagttcgccgacatcttcaccgccgacaagccggtgctgttcgcgtaccactcctacgcccacgacgtgcgtggcctgatctacgatcgcccgaaccacgataacttcaacgtccacggctacgaggaggagggctccaccaccaccccgtacgacatggttcgcgtgaacgagctggatcgctacgagctgaccgccgaagccctgcgcatgatcgacgccgacaagtacgccgacgagatccagaagctggaggacttccgtcaggaagcgttccagttcgcggtcgacaagggctacgaccacccggactacaccgactgggtgtactcgggcgtcaagaccgacaagaagggcgccgtcaccgccaccgccgccaccgctggcgacaacgagtga

SEQ ID NO: 156 - protein, 801 aa, Bifidobacterium bifidum
  misc_feature: PHK
MDKYWRVANYLSIGQIYLRSNPLMKEPFTREDVKHRLVGHWGTTPGLNFLIGHINRFIADHGQNTVFIMGPGHGGPAGTSQSYLDGTYTETYPNITKDEAGLQKFFRQFSYPGGIPSHFAPETPGSIHEGGELGYALSHAYGAIMDNPSLFVPCIVGDGEAETGPLATGWQSNKLVNPRTDGIVLPILHLNGYKIANPTILSRISDEELHEFFHGMGYEPYEFVAGFDDEDHMSIHRRFAELFESVWDEICDIKAAANTDNMHRPFYPMIIFRTPKGWTCPKYIDGKKTEGSWRAHQVPLASARDTEAHFEVLKNWLESYKPEELFDANGAVKDDVLAFMPKGELRIGANPNANGGVIRRDLVLPALEDYEVKEVKEFGHGWGQLEATRRLGVYTRDIIKNNMHDFRIFGPDETASNRLQASYEVTNKQWDAGYISDEVDEHMHVSGQVVEQLSEHQMEGFLEAYLLTGRHGIWSSYESFVHVIDSMLNQHAKWLEATVREIPWRKPIASMNLLVSSHVWRQDHNGFSHQDPGVTSVLLNKCFHNDHVIGIYFATDANMLLAIAEKCYKSTNKINAIIAGKQPAATWLTLDEARAELAKGAAAWDWASTAKTNDEAQVVLAAAGDVPTQEIMAASDKLKALGIKFKVVNVADLLSLQSAKENDEALTDEEFADIFTADKPVLFAYHSYAHDVRGLIYDRPNHDNFNVHGYEEEGSTTTPYDMVRVNELDRYELTAEALRMIDADKYADEIQKLEDFRQEAFQFAVDKGYDHPDYTDWVYSGVKTDKKGAVTATAATAGDNE

SEQ ID NO: 157 - DNA, 2481 bp, Bifidobacterium gallicium
  misc_feature: PHK
atgacaagtcctgttattggcaccccctggcagaagctgaaccgtccggtttcggaagaggccatcgaaggcatggacaagtattggcgcgcgtccaactacatgtccatcggccagatctacctgcgtagcaacccgctgatgaaggaacctttcactcgcgatgacgtgaagtaccgcctcgtcggccactggggtaccaccccgggcctgaacttccttctggcccacatcaaccgcctgatcgctgaccaccagcagaacaccgtgttcatcatgggtcctggccacggcggtcctgccggtactgcacagtcctatctggacggcacgtacaccgagtactacccgaacatcaccaaggatgaggaaggcctgcagaagttcttccgtcagttctcttatccgggcggcattccttcgcacttcgctccggagaccccgggctcgatccacgaaggtggcgagctgggctatgctctgtcccacgcttacggcgctgtgatgaacaacccgagcctgttcgtgccctgcatcgtcggcgacggcgaagctgagactggccctctggccaccggctggcagtccaacaagctcgtgaacccgcgcaccgatggcatcgtgctgccgatcctgcacctcaacggctacaagatcgccaacccgaccatcctcgctcgcgtgtccgatgaagagctgcatgacttcttccgcggcctgggctaccacccgtacgagttcgtcgccggcttcgacaacgaggatcacctgtcgatccaccgtcgtttcgctgagctcttcgagaccatcttcgacgagatctgcgatatcaaggctgccgccaacacggatgacatgacccgtccgttctacccgatgctgattttccgcaccccgaagggttggacctgcccgaagttcatcgacggcaagaagaccgaaggctcttggcgtgcacaccaggtgccgctggcttccgcccgcgataccgaggctcacttcgaagtgctgaagaactggatggcttcctacaagccggaagagctcttcgacgacaagggcgccatcaaggatgacgtcgtcgacttcatgccgaagggcgatctgcgtatcggcgccaacccgaatgctaacggtggcgtgatccgtgaagagctcgatctgccggccctcgagaactatgaggtcaaggaagtcaaggaattcggccacggctggggccagcttgaggctacgcgtaagctcggtgagtacacgcgtgacatcatcaagaacaacccggattcgttccgcatcttcggacctgacgagaccgcttcgaaccgtctgcaggcttcctacgaagtcaccaacaagcagtgggacaacggctacctgtccaaggacctcgtcgatgagcacatggctgtcaccggccaggtcactgagcagctctccgaacaccagtgcgaaggcttcctcgaggcctacctgctcacgggtcgtcacggcatctggagctcctacgagtccttcgtgcacgtcatcgactccatgctcaaccagcacgccaagtggctcgaggctacggtgcgtgagattccgtggcgtaagccgatctcctcgatgaacctgctcgtgtcctcgcacgtgtggcgtcaggatcacaacggcttctcgcaccaggatccgggtgtcacctccgtcctgttgaacaagacgttcaacaacgatcacgtcatcggcctgtacttcgcaaccgacgccaacgtgctgctggccatcgctgagaagtgctacaagtcgaccaacatgatcaacgccatcgtcgccggcaagcagcctgctgccacctggacgacgctggacgaagctcgtgagctggttgccaagggcgctggcgaattcgagtgggcttcgaacgtcaagaccaacgatgaggccgagattgtgctcgcttccgctggcgatgttccgactcaggagctcatggctgctgctgatcgtctgaacaagctcggcgtcaagttcaaggtcgtcaacgtggtggatctgatcaagctgcagtccgccaaggagaacgatcaggctctgtccgatgccgagttcgctgagctcttcaccgaagacaagccggtgctgttcgcgtaccactcctatgcgcacgacgtgcgcggcctgatcttcgatcgcccgaaccacgacaacttcaacgtggtcggctacaaggagcagggctccaccaccacgccgtacgacatggtgcgtgtcaacgacatcgatcgttatgagctgaccgctacggcactgcgcatgatcgacgccgacaagtacgccgacgagatcaagaagctcgaggacttccgcatcgaggcttaccagttcgctgtcgacaacggctacgacattccggattacaccgactgggtgtggccgggcgtcaagaccgacctgccgggcgccgtttccgcaacggctgccaccgcaggcgacaacgagtga

SEQ ID NO: 158 - protein, 826 aa, Bifidobacterium gallicium
  misc_feature: PHK
MTSPVIGTPWQKLNRPVSEEAIEGMDKYWRASNYMSIGQIYLRSNPLMKEPFTRDDVKYRLVGHWGTTPGLNFLLAHINRLIADHQQNTVFIMGPGHGGPAGTAQSYLDGTYTEYYPNITKDEEGLQKFFRQFSYPGGIPSHFAPETPGSIHEGGELGYALSHAYGAVMNNPSLFVPCIVGDGEAETGPLATGWQSNKLVNPRTDGIVLPILHLNGYKIANPTILARVSDEELHDFFRGLGYHPYEFVAGFDNEDHLSIHRRFAELFETIFDEICDIKAAANTDDMTRPFYPMLIFRTPKGWTCPKFIDGKKTEGSWRAHQVPLASARDTEAHFEVLKNWMASYKPEELFDDKGAIKDDVVDFMPKGDLRIGANPNANGGVIREELDLPALENYEVKEVKEFGHGWGQLEATRKLGEYTRDIIKNNPDSFRIFGPDETASNRLQASYEVTNKQWDNGYLSKDLVDEHMAVTGQVTEQLSEHQCEGFLEAYLLTGRHGIWSSYESFVHVIDSMLNQHAKWLEATVREIPWRKPISSMNLLVSSHVWRQDHNGFSHQDPGVTSVLLNKTFNNDHVIGLYFATDANVLLAIAEKCYKSTNMINAIVAGKQPAATWTTLDEARELVAKGAGEFEWASNVKTNDEAEIVLASAGDVPTQELMAAADRLNKLGVKFKVVNVVDLIKLQSAKENDQALSDAEFAELFTEDKPVLFAYHSYAHDVRGLIFDRPNHDNFNVVGYKEQGSTTTPYDMVRVNDIDRYELTATALRMIDADKYADEIKKLEDFRIEAYQFAVDNGYDIPDYTDWVWPGVKTDLPGAVSATAATAGDNE

SEQ ID NO: 159 - DNA, 2478 bp, Bifidobacterium animalis
  misc_feature: PHK
atgactaatcctgttattggtaccccatggcagaagctggaccgtccggtttccgaagaggccatcgaaggcatggacaagtactggcgcgtcgccaactacatgtccatcggccagatctacctgcgtagcaacccgctgatgaaggagcccttcacccgcgatgacgtgaagcaccgtctggtcggccactggggcaccaccccgggcctgaacttccttctcgcccatatcaaccgcctgatcgccgatcaccagcagaacaccgtgttcatcatgggtcctggccacggcggccctgcaggtaccgctcagtcctacatcgacggcacctacaccgagtactacccgaacatcaccaaggacgaggctggcctgcagaagttcttccgccagttctcctacccgggtggcattccttcccacttcgctccggagacgccaggctccatccacgaaggcggcgagctgggctacgccctgtcgcacgcctacggcgcgatcatgaacaacccgagcctcttcgtcccgtgcatcatcggtgacggcgaagccgagaccggccctctggccaccggctggcagtccaacaagctcgtcaacccgcgcaccgacggcatcgtgctgccgatcctgcacctcaacggctacaagatcgccaacccgacgctcctcgcccgcatctccgacgaggagctgcacgacttcttccgcggtatgggttaccacccgtacgagttcgtcgccggcttcgacaacgaggatcacctgtcgatccaccgtcgcttcgccgagctcttcgagaccatcttcgacgagatctgcgatatcaaggctgcggctcagaccgacgacatgacccgtccgttctacccgatgctcatcttccgcaccccgaagggctggacctgcccgaagttcatcgacggcaagaagaccgaaggctcctggcgtgcacaccaggtcccgctggcttccgcccgcgacaccgaggcccacttcgaagtcctcaagggctggatggaatcctacaagccggaggagctcttcaacgccgacggctccatcaaggacgacgtcaccgcattcatgcctaagggcgaactgcgcatcggcgccaacccgaacgccaacggtggccgcatccgcgaggatctgaagctccctgagctcgatcagtacgagatcaccggcgtcaaggaatacggccatggctggggccaggtcgaggctccgcgctccctcggcgcgtactgccgcgacatcatcaagaacaacccggattcgttccgcatcttcggacctgatgagaccgcatccaaccgtctgaacgcgacctacgaggtcaccaagaagcagtgggacaacggctatctctcggctctcgtcgacgagaacatggctgtcaccggccaggttgtcgagcagctctccgagcatcagtgcgaaggcttcctcgaggcctacctgctcacgggccgccacggcatgtggagcacctatgagtccttcgcccacgtgatcgactcgatgctcaaccagcatgcgaagtggctcgaggcgaccgtccgcgagatcccgtggcgcaagccgatctcctcggtcaacctcctcgtctcctcgcacgtgtggcgtcaggaccacaacggcttctcgcatcaggacccgggtgtcacctccgtcctgatcaacaagacgttcaacaacgaccacgtgacgaacatctacttcgcgaccgacgccaacatgctgctcgcgatcgccgagaagtgcttcaagtccaccaacaagatcaacgcgatcttctccggcaagcagccggctccgacctggattaccctcgacgaggctcgtgccgagctcgaggccggcgccgccgagtggaagtgggcttccaacgccaagagcaacgacgaggtccagattgtcctcgccgccgcaggcgatgtcccgacccaggagatcatggccgcttccgatgccctgaacaaggatggcatcaagttcaaggtcgtcaacgttgttgacctcctgaagctgcagtccccggagaacaacgacgaggccatgtcgaacgaagacttcaccgagctcttcaccgccgacaaaccggttctgttcgcctaccactcctatgcccaggacgttcgtggtcttatctacgaccgcccgaaccacgacaacttcaacgttgtcggctacaaggagcagggctccacgaccacgccgttcgacatggtccgcgtcaacgacatggatcgctacgcgctcgaagctcaggctctcgagctgatcgacgccgacaagtatgccgacaagatcgacgagctcaacgcgttccgcaagaccgcgttccagttcgccgtcgacaacggctacgacatcccggagttcaccgactgggtgtacccggacgtcaaggtcgacgagacgcagatgctctccgcgaccgcggcgaccgctggcgacaacgagtga

SEQ ID NO: 160 - protein, 825 aa, Bifidobacterium animalis
  misc_feature: PHK
MTNPVIGTPWQKLDRPVSEEAIEGMDKYWRVANYMSIGQIYLRSNPLMKEPFTRDDVKHRLVGHWGTTPGLNFLLAHINRLIADHQQNTVFIMGPGHGGPAGTAQSYIDGTYTEYYPNITKDEAGLQKFFRQFSYPGGIPSHFAPETPGSIHEGGELGYALSHAYGAIMNNPSLFVPCIIGDGEAETGPLATGWQSNKLVNPRTDGIVLPILHLNGYKIANPTLLARISDEELHDFFRGMGYHPYEFVAGFDNEDHLSIHRRFAELFETIFDEICDIKAAAQTDDMTRPFYPMLIFRTPKGWTCPKFIDGKKTEGSWRAHQVPLASARDTEAHFEVLKGWMESYKPEELFNADGSIKDDVTAFMPKGELRIGANPNANGGRIREDLKLPELDQYEITGVKEYGHGWGQVEAPRSLGAYCRDIIKNNPDSFRIFGPDETASNRLNATYEVTKKQWDNGYLSALVDENMAVTGQVVEQLSEHQCEGFLEAYLLTGRHGMWSTYESFAHVIDSMLNQHAKWLEATVREIPWRKPISSVNLLVSSHVWRQDHNGFSHQDPGVTSVLINKTFNNDHVTNIYFATDANMLLAIAEKCFKSTNKINAIFSGKQPAPTWITLDEARAELEAGAAEWKWASNAKSNDEVQIVLAAAGDVPTQEIMAASDALNKDGIKFKVVNVVDLLKLQSPENNDEAMSNEDFTELFTADKPVLFAYHSYAQDVRGLIYDRPNHDNFNVVGYKEQGSTTTPFDMVRVNDMDRYALEAQALELIDADKYADKIDELNAFRKTAFQFAVDNGYDIPEFTDWVYPDVKVDETQMLSATAATAGDNE

SEQ ID NO: 161 - DNA, 2367 bp, Lactobacillus pentosum
  misc_feature: PHK
atgtctacagattactcatcaccagcatatttgcaaaaagttgataagtactggcgtgctgccaactatttatcagttggtcaactttatttaaaagataatcctttattacaacggccattaaaggctagtgacgttaaggttcacccaatcggtcactggggcacgattgccggccaaaacttcatctatgcgcatcttaaccgggtcatcaacaagtacggtttgaagatgttctacgttgaaggtccaggtcatggtggccaagtgatggtctccaactcataccttgatgggacttacacggatatttatcctgaaattacgcaggatgttgaagggatgcaaaaactcttcaagcaattctcattcccaggtggcgtggcttcccatgctgctcctgaaacaccaggctcaatccacgaaggtggcgaacttggttactcaatttcacacggtgttggggcaatccttgacaaccctgatgaaatcgccgcagtcgttgttggtgatggggaatccgaaaccggcccattagcaacttcatggcaatcaacgaagttcatcaacccaatcaacgatggggcagtgttaccaatcttgaaccttaacggctttaagatttctaacccaacgatttttggtcggacttctgatgaaaagatcaagcaatacttcgaaagcatgaactgggaaccaatctttgttgaaggtgacgatcctgaaaaggttcacccagctttagctaaggccatggatgaagccgtcgaaaagatcaaagccattcaaaagaacgctcgtgaaaacgatgacgctactttaccagtatggccgatgatcgtcttccgcgcacctaagggctggactggtcctaagtcatgggatggcgacaagatcgaaggttcattccgagctcaccaaattccaattcctgttgaccaaaccgacatggaacatgccgatgcgttagttgactggttggaatcatatcaaccaaaggaactcttcaatgaagatggttctttgaaggatgatatcaaagaaattatcccaactggcgatgcacggatggccgctaacccaatcactaatggtggggttgatccaaaggccttgaacttacctaacttccgtgattacgccgttgatacgtctaagcatggtgccaacgttaagcaagatatgatcgtttggtcagactacttgcgtgatgttatcaagaagaacccagataacttccggttatttggccctgatgaaaccatgtcaaaccggttatatggtgtctttgaaaccactaaccgtcaatggatggaagatattcacccagatagtgaccaatacgaagcacctgctggccgggtcttggatgctcaattatctgaacaccaagctgaaggttggttagaaggttacgtcttaactggtcgtcatggcttgtttgcaagttacgaagccttcttacgggttgtcgactcaatgttgacgcaacacttcaagtggttacgtaaggccaacgaacttgactggcggaagaagtacccgtcactcaacattatcgcggcttcaactgtgttccaacaagaccataatgggtacacccaccaagatccaggtgccttgactcatttggctgaaaagaagcctgaatatatccgcgaatatttaccagccgacgccaactccttgttagctgttggggacgtcatcttccgtagccaagaaaagatcaactacgtggttacgtcgaagcacccacgtcaacaatggttcagcattgaagaagctaagcaattagttgacaacggtcttggtatcattgactgggcaagcacggaccaaggtagcgaaccagatatcgtgtttgctgctgccggaacggaaccaacgcttgaaacgttggctgcaatccaattgctccatgatagcttcccagacatgaagattcgtttcgtgaacgtggtcgacatcttgaagttacgtagccctgaaaaggaccctcgtggcttgtcagatgctgaatttgaccattacttcactaaggacaaaccagttgtcttcgccttccatggttacgaagacctggttcgtgacatcttctttgatcgtcacaaccacaacttacacgtgcatggctaccgtgaaaatggtgacattacgacaccattcgatgtccgggtcatgaaccaaatggaccgtttcgacttagcaaaatctgcaattgcggcgcaaccagcaatggaaaacaccggtgcagcctttgttcaagacatggataacatgcttgcaaaacacaacgcatacatccgtgacgccggaaccgacttgccagaagttaacgactggcaatggaaaggtttgaaataa

SEQ ID NO: 162 - protein, 788 aa, Lactobacillus pentosum
  misc_feature: PHK
MSTDYSSPAYLQKVDKYWRAANYLSVGQLYLKDNPLLQRPLKASDVKVHPIGHWGTIAGQNFIYAHLNRVINKYGLKMFYVEGPGHGGQVMVSNSYLDGTYTDIYPEITQDVEGMQKLFKQFSFPGGVASHAAPETPGSIHEGGELGYSISHGVGAILDNPDEIAAVVVGDGESETGPLATSWQSTKFINPINDGAVLPILNLNGFKISNPTIFGRTSDEKIKQYFESMNWEPIFVEGDDPEKVHPALAKAMDEAVEKIKAIQKNARENDDATLPVWPMIVFRAPKGWTGPKSWDGDKIEGSFRAHQIPIPVDQTDMEHADALVDWLESYQPKELFNEDGSLKDDIKEIIPTGDARMAANPITNGGVDPKALNLPNFRDYAVDTSKHGANVKQDMIVWSDYLRDVIKKNPDNFRLFGPDETMSNRLYGVFETTNRQWMEDIHPDSDQYEAPAGRVLDAQLSEHQAEGWLEGYVLTGRHGLFASYEAFLRVVDSMLTQHFKWLRKANELDWRKKYPSLNIIAASTVFQQDHNGYTHQDPGALTHLAEKKPEYIREYLPADANSLLAVGDVIFRSQEKINYVVTSKHPRQQWFSIEEAKQLVDNGLGIIDWASTDQGSEPDIVFAAAGTEPTLETLAAIQLLHDSFPDMKIRFVNVVDILKLRSPEKDPRGLSDAEFDHYFTKDKPVVFAFHGYEDLVRDIFFDRHNHNLHVHGYRENGDITTPFDVRVMNQMDRFDLAKSAIAAQPAMENTGAAFVQDMDNMLAKHNAYIRDAGTDLPEVNDWQWKGLK

SEQ ID NO: 163 - DNA, 2313 bp, Lactobacillus acidophilus
  misc_feature: PHK
atgaaaaatccgttgttaaagaaacctttaacagctgaagatgtaaaacctaagccaatcggtcactggggtactattgctccacaaaactttatttatgctcacttaaatcgtgcgcttaaaaaatatgacttggatatgttctatattgaaggttcaggtcacggtggccaagtgatggtttcaaattcatatcttgatggttcatatactgaacgttatccagaaattacccaagatgaaaagggtatggctaaattgtttaagcgctttagtttcccaggtggtgtagcttctcacgctgctcctgaaactccaggttctattcatgaaggtggggaattaggatacgcactttcacatggggtaggtgctattttagacaatccagatgtaattgctgccgttgaaattggtgatggtgaagcagaaactggtccacttgcagctagctggttcagtgacaagtttattaatccaattaaggatggtgcagttttaccaattcttcaaattaatggtttcaagatttctaacccaactatcgtttcaagaatgagcgatgaagaattaactgaatacttccgtggcatgggttgggatccgcactttgtttcagtatttaagggtggccgctttgacggtgaaaaggatccaatgcaagtccacgaagaaatggctaaaaccatggacgaagtaattgaagaaattaaggctattcaaaagcatgctcgtgaaaataatgatgctactttgccacattggccattgattatcttccaatgtccaaagggctggaccggtccaaagaaggatcttgacggcaatccaattgaaaactcatttagagcacaccaaattccaattcctgtctcacaatacgatatgaaacatgttgatatgttgactgattggcttgaaagttataagccaaacgaattattcaacgaagatggttcaccaaaggaaattgttactgaaaacactgctaagggtgatcaacgtatggcaatgaatccgatcactaatggtggtaaggatcctaaacgattgaacctaccagattatcgcaactttgcacttaagtttgacaagccaggttcagttgaagcacaagacatggttgaatgggctaaatatttaaacgaagttgctaaacttaacccaactactttccgtggctttggtcctgatgaatctaaatcaaaccgtttatttaaacttttagatgatcaaaagcgtcaatgggaacctgaagttcatgaaccaaatgatgaaaacttggcaccaagtggccgcgttatcgattcacaattatcagaacaccaagacgaaggcttccttgaaggctacgttttaactggtcgtcacggcttctttgcaacctacgaagcatttggtcgtgtagtagattcgatgcttactcaacatatgaagtggcttagaaaagctaaagaacaatattggcgtcatgattatccatcacttaactttgttgctacttcaacagtattccaacaagatcacaatggttacactcaccaagatccaggcattttaactcacttatatgaaaagaatcgtccagatttagttcatgaatacttgccatcagatactaatactttacttgctgtaggtaacaaggcatttactgatcgtgaatgtattaatgttttagtaacttcaaagcaacctcgtccacaatggttctcaattgaggaagcacaaaagttagttgataaaggtttaagttacattgattgggcttcaactgataaaggtgtaaaaccagatattgtctttgcttcaacagaaactgaaccaacaattgaaactttggcagcaattgatattttgcatgacaagttcccagatcttaagattcgctacattaacgtaattgatgtgatgaaattaatgtcaccaaaggacaataagaatggtatttctgatgaagaatttgatcgcttattcccaaaggacgttcctgtaatctttgcatggcacggctacaagagtatgatggaatcaatttggtttgcacgtaaccgtcataatgtacatattcactgctacgaagaaaacggtgatattactaccccatttgatatgcgtgttttgaaccaccttgacagatttgatcttgccaaagatgctgttgaaagtgttgataaattgaagggcaagaacgctgactttatcagtcatatggatgacttgcttgaaaagcaccaccaatacattcgtgataatggtaaagatatgccagaagttactgaatggaagtggaagggcttgaagaatgacagt

SEQ ID NO: 164 - protein, 799 aa, Lactobacillus acidophilus
  misc_feature: PHK
MTVNYDSKDYLKSVDAYWRAANYLSVGQLFLMKNPLLKKPLTAEDVKPKPIGHWGTIAPQNFIYAHLNRALKKYDLDMFYIEGSGHGGQVMVSNSYLDGSYTERYPEITQDEKGMAKLFKRFSFPGGVASHAAPETPGSIHEGGELGYALSHGVGAILDNPDVIAAVEIGDGEAETGPLAASWFSDKFINPIKDGAVLPILQINGFKISNPTIVSRMSDEELTEYFRGMGWDPHFVSVFKGGRFDGEKDPMQVHEEMAKTMDEVIEEIKAIQKHARENNDATLPHWPLIIFQCPKGWTGPKKDLDGNPIENSFRAHQIPIPVSQYDMKHVDMLTDWLESYKPNELFNEDGSPKEIVTENTAKGDQRMAMNPITNGGKDPKRLNLPDYRNFALKFDKPGSVEAQDMVEWAKYLNEVAKLNPTTFRGFGPDESKSNRLFKLLDDQKRQWEPEVHEPNDENLAPSGRVIDSQLSEHQDEGFLEGYVLTGRHGFFATYEAFGRVVDSMLTQHMKWLRKAKEQYWRHDYPSLNFVATSTVFQQDHNGYTHQDPGILTHLYEKNRPDLVHEYLPSDTNTLLAVGNKAFTDRECINVLVTSKQPRPQWFSIEEAQKLVDKGLSYIDWASTDKGVKPDIVFASTETEPTIETLAAIDILHDKFPDLKIRYINVIDVMKLMSPKDNKNGISDEEFDRLFPKDVPVIFAWHGYKSMMESIWFARNRHNVHIHCYEENGDITTPFDMRVLNHLDRFDLAKDAVESVDKLKGKNADFISHMDDLLEKHHQYIRDNGKDMPEVTEWKWKGLK

SEQ ID NO: 165 - DNA, 2469 bp, Penicillium chrysogenum
  misc_feature: PHK
atgcctgcagaagttataagcgaaccaaatccacaagctctgccgtcgcatctgccagactatcttgagaaattgagcgtcagcttggaacgtgagaaactagatgaaaagacctacgatgccttgatcaagttccgccgagcggcttgttacattgcggcagctatgatatttctgcaagaaaatactcttttgaagtcagaactcacatttcaacatgtcaagcctagactactcggtcactggggaacatgcccgggcctaatctttgtctactctcatttgaactacctgatccggacaatgaatctggacatgttgtacgttgtcggtccaggacatggcgcaccggcaatactagccgcgctatggttggagggttcgctggagaaattctatccccactattcgcgagacgaaaagggcctacacagattgatctcgacctttagtaccacaggtggttttcccagccacatcaattccgagacccccggtgcaatccatgaaggtggagaactgggttacgctctggcagtgtcctttggcgctgtcatggataaccccgatctgattgtgacttgtattgtgggggacggggaggctgaaagcggtcccactgctacgtcctggcatgcgatcaagtacattgatccaaaggagtccggtgcagttttaccaattctgcatttgaatggattcaagatcagcgagcgcactatcttcgggtgcatggaccacaaagagcttttgactctcttcagtggatacgggtaccaggttcgctttgtcgaggataacaacgatattgatgcggatttacacacctctatgatctgggccgtcaatgaaatccagaagatccagaaggctgcccgttcagggaagccgattatgaagccaaggtggccgatgctgattctgcgtacttccaagggctggactgggcccaagcagcttcatggcaagtttcttgagggctcataccattctcaccaggtgccattgcccaaagcaaagaccgacaaggaacaactagatctgctgcagaattggctgtctagttataagccagaagagctgttcacttcgaacggtgatgtaattgatgagatcaagtctgtgatacccacagaagacaaaaagaagcttggccagcgcatcgaagtctacaatagttatacaccaccgaatctgccggattggaagcccttctgcgcggataaaggctctcaagaaagcgctatgaaagcggctggcaccttcattaatcagacattcaaggacaacccgaacagcgtgcgactcttctcgccggacgagttggaaagcaacaaactcgatgcggtatttgaatacacaaaccgcaatttccaatgggacgagttcgccaatgcccgcggcggccgtgtaattgaagtccttagcgaacatatgtgtcaaggattcatgcagggctataccttgaccgggcgcattggtattttcccgtcctatgagagcttcctcggcatcattcatacgatgatggtgcagtatgccaagttcatcaagatgggactggaaacaacttggcactccggcgtcagtagtgtgaactacatcgaatcgagcacctgggcacgccaagaacacaacggcttctctcaccagaacccatccttcatcggcgctgtgctaaagctgaagcctagtgcagctcgggtatacttaccaccagatgcgaatactttcctgacaaccatccaccattgtttaaaatcaaagaattacatcaacctaatggtaggctcaaagcagccaactccagtgtacctgactcccaaagaggcggaaagccactgtcgcgcaggagcatccatttggaagttctgcagcacggacgatggaattaatccggatgtcgtgctggtcggtattggtgttgaggtgatgttcgaagtaattgcggcagcggcgcttctgcgtaagctcatcccagagcttcgtgtttgtgtcattaacgtgacggacctgatgattcttgataacgagggtgcgcatccgcatgccctgtccactgaggcattcgatggtctctttacttccgacaggcccattcacttcaattaccacggctatccaactgagctgcagggtttgctctttggacgtccccgccttgatcgcgtcagtgtcgccggctatatcgaagagggtagcaccaccacgcctttcgacatgatgcttgtcaaccgtgtctcgcgtttccatgtcgcccagcatgctattcgtggtgctgccaaagtaaatgagaaggtcagggtgtatcagcaggagctgaatgctcagcttgaggcgagtatggtcagcacgaggaagtatattgtggaaaaccgggatgaccccgacggcatttatgacatgccacaattccacagcttccacaaaccggctgagtctgagacattctggaatattgcccagtag

SEQ ID NO: 166 - protein, 822 aa, Penicillium chrysogenum
  misc_feature: PHK
MPAEVISEPNPQALPSHLPDYLEKLSVSLEREKLDEKTYDALIKFRRAACYIAAAMIFLQENTLLKSELTFQHVKPRLLGHWGTCPGLIFVYSHLNYLIRTMNLDMLYVVGPGHGAPAILAALWLEGSLEKFYPHYSRDEKGLHRLISTFSTTGGFPSHINSETPGAIHEGGELGYALAVSFGAVMDNPDLIVTCIVGDGEAESGPTATSWHAIKYIDPKESGAVLPILHLNGFKISERTIFGCMDHKELLTLFSGYGYQVRFVEDNNDIDADLHTSMIWAVNEIQKIQKAARSGKPIMKPRWPMLILRTSKGWTGPKQLHGKFLEGSYHSHQVPLPKAKTDKEQLDLLQNWLSSYKPEELFTSNGDVIDEIKSVIPTEDKKKLGQRIEVYNSYTPPNLPDWKPFCADKGSQESAMKAAGTFINQTFKDNPNSVRLFSPDELESNKLDAVFEYTNRNFQWDEFANARGGRVIEVLSEHMCQGFMQGYTLTGRIGIFPSYESFLGIIHTMMVQYAKFIKMGLETTWHSGVSSVNYIESSTWARQEHNGFSHQNPSFIGAVLKLKPSAARVYLPPDANTFLTTIHHCLKSKNYINLMVGSKQPTPVYLTPKEAESHCRAGASIWKFCSTDDGINPDVVLVGIGVEVMFEVIAAAALLRKLIPELRVCVINVTDLMILDNEGAHPHALSTEAFDGLFTSDRPIHFNYHGYPTELQGLLFGRPRLDRVSVAGYIEEGSTTTPFDMMLVNRVSRFHVAQHAIRGAAKVNEKVRVYQQELNAQLEASMVSTRKYIVENRDDPDGIYDMPQFHSFHKPAESETFWNIAQ

SEQ ID NO: 167 - DNA, 2421 bp, Aspergillus nidulans; identical to SEQ ID NO: 143
  misc_feature: PHK

SEQ ID NO: 168 - protein, 780 aa, Aspergillus nidulans
  misc_feature: PHK
MPGEVIERPNPAPKPSHVPDLVEKLIIPAQKTKLEKSDCDALHKYRRAAAYIAAGHWGTCPGLILVYSHLNYLIKKQNLDMLYVVGPGHGAPGLLASLWLEGSLGKFYPQYTKDKEGLHNLISTFSTSAGLPSHINAETPGAIHEGGELGYALSVSFGAVMDNPDLIVTCVVGDGEAETGPTATSWHAIKYIDPAESGAVLPILHVNGFKISERTIFGCMDNREIVCLFTGYGYQVRIVEDLEDIDNDLHSAMSWAVEEIRNIQKAARSGKPIMKPQWPMIVLRTPKGWSGPKELHGQFIEGSFHSHQVPLPNAKKDDEELQALQKWLSSYKPDELFTESGDVIDEILSIIPSDDKKLGMRPEAYKTHLPPDLPDWRQFCVKKGDQFSAMKAIGSFIDQVFVKNPHTVRLFSPDELESNKLSAALSHTGRNFQWDEFSNAKGGRVIEVLSEHLCQGFMQGYTLTGRTGIFPSYESFLGIIHTMMVQYAKFAKMAKETAWHHDVSSINYIETSTWARQEHNGFSHQNPSFIGAVLKLKPYAARVYLPPDANTFLTTLHHCLKSKNYINLMVGSKQPTPVYLSPEEAESHCRAGASIFKFCSTDGGLRPDVVLVGIGVEVMFEVIKAAAILRERCPELRVRVVNVTDLFILENEGAHPHALKHEAFDNLFTEDRSIHFNYHGYVNELQGLLFGRPRLDRATIKGYKEEGSTTTPFDMMLVNEVSRYHVAKAAVTGGARFNEKVKLRHQELCSEFDHNIAETRKYIMNNHQDPEDTYNMPSFN

SEQ ID NO: 169 - DNA, 2421 bp, Aspergillus clavatus
  misc_feature: PHK
atgcctggggaagtcattgacagaccaaacccgcaggcgctgccttcccatattcccgatgtggttgaacagttgcaggtgaagctggatttgacgagtttagagcaaccggcctgcgatgccttgttcaaattccgtcgagctgcttcatacatcgctgcagcaatgatctttctgcaagataatgtgctactgaaaagaagcttgacgcatgacgacataaagcctagattgcttggtcattggggaacatgtcccggcctgatattggtatactctcacctgaattacctcattacaaagcgcaatctcaatatgctgtatgtcgtgggaccaggacatggtgcaccagccatcctagcctctctctggctggagggctcgttggagaagttctacccagagtattcgcgaaatgcggagggcctcgccaatctcatctcgactttcagtacaacagccgggctgcctagccatatcaatgcggaaacaccaggtgctatccacgaaggaggggaactgggatacgcacttgctgtatcatttggtgcagttatggacaaccccaatctgatcgttccatgcattgtgggcgatggagaagcagaaactggcccaacagcagcatcttggcacggcatcaaatatatcgatcctgcagagtcaggcgctgtgctgccaatcctgcacctgaacggattcaagatcagcgagcgcacgatctttggctgcatggacgacaaggagctgacctcgcttttcactgggtatgggtaccaggtccggattgtgcaggatttgaatgacatcgacaccgatctccatcgatctatgacctgggctttggaagaaatccacaagattcagcaagcagcgcgatccggaaagcccattatgaagccaagatggccaatgctgattttgcgcacaccaaagggatggtcaggcccaaaggaaattcatggccagttcattgagggctcattccattcacatcaagtccccctgcccaacgcaaagaaggacaaggaagagctgcaggccctcgagaaatggctttcctcgtatgggcccagagaacttttcactgagaatggagatgttatagatgagattaaatccatcatccctacggatgatgcgatgaagcttggtcagcgtgtggaggcatacaaggcttatctgccaccaaagctcccggactggaggaagttcgccgtggataaaggtagccaacagagcccgatgaaaacgaccggaaagcttatcgacgaggtcttccaactcaaccctcacactgttcgattgttttcaccggatgaattggagagcaacaaactgagcgccgctctggatcacactgggagaaatttccagtgggatcagttctctagcgcgaaaggtggccgggtcatcgaagtcctgagcgaacatatgtgccagggttttatccagggttacacgttgaccggacgcacgggtatcttcccatcgtatgagagcttcttgggaatcgttcataccatgatggtgcagtactccaaattcatcaaaatggctcaagagaccacatggcaccgtagcatagccagcatcaattatattgagacaagcacgtggacacggcaggagcataatggattttcacaccagaatccatctttcatcggggcagtactcaaattgaagcccacggctgctcgggtttatctgccgccggatgctaacactttcttaatcactctccatcactgcttgaagtcgacgaactacatcaatctcatggttagttcgaagcagcccactccggtgtatttgaccccagaagaggcagagagccactgcagagcaggtgcatctgtctggaaattctgcagcaccgacgatggtctggacccagacgtagtattggttggaatcggcgtcgaggtgatgtttgaagtcattgctgctgccgccattctgcgcaaacgttgccccgagcttcgcgtacgggtggttaacgtcaccgatttgatgatcttggagaacgaaggcgcacacccgcatgcgctcaccaccgacgcgtttgatagcctgtttacatctgacagacccatccatttcaactaccacggatatccgactgagttgcagggcttgctgttcggacggccacgtctggagcgcgctaccatcggcggatacatggaggagggaagcaccacgacaccatttgatatgatgcttgtcaaccgcgtttcacgcttccatgtagcacaagcggccatttgtggggcgtcaaagagaaatgaaagagttcagatccgacaacaggagctgtacacggagttggaccacaatatggtagagaccaagaagtacatcctcaaaaaccgaaaggatcccgatgatatgtacgatatgccgaaattcgaataa

SEQ ID NO: 170 - protein, 806 aa, Aspergillus clavatus
  misc_feature: PHK
MPGEVIDRPNPQALPSHIPDVVEQLQVKLDLTSLEQPACDALFKFRRAASYIAAAMIFLQDNVLLKRSLTHDDIKPRLLGHWGTCPGLILVYSHLNYLITKRNLNMLYVVGPGHGAPAILASLWLEGSLEKFYPEYSRNAEGLANLISTFSTTAGLPSHINAETPGAIHEGGELGYALAVSFGAVMDNPNLIVPCIVGDGEAETGPTAASWHGIKYIDPAESGAVLPILHLNGFKISERTIFGCMDDKELTSLFTGYGYQVRIVQDLNDIDTDLHRSMTWALEEIHKIQQAARSGKPIMKPRWPMLILRTPKGWSGPKEIHGQFIEGSFHSHQVPLPNAKKDKEELQALEKWLSSYGPRELFTENGDVIDEIKSIIPTDDAMKLGQRVEAYKAYLPPKLPDWRKFAVDKGSQQSPMKTTGKLIDEVFQLNPHTVRLFSPDELESNKLSAALDHTGRNFQWDQFSSAKGGRVIEVLSEHMCQGFIQGYTLTGRTGIFPSYESFLGIVHTMMVQYSKFIKMAQETTWHRSIASINYIETSTWTRQEHNGFSHQNPSFIGAVLKLKPTAARVYLPPDANTFLITLHHCLKSTNYINLMVSSKQPTPVYLTPEEAESHCRAGASVWKFCSTDDGLDPDVVLVGIGVEVMFEVIAAAAILRKRCPELRVRVVNVTDLMILENEGAHPHALTTDAFDSLFTSDRPIHFNYHGYPTELQGLLFGRPRLERATIGGYMEEGSTTTPFDMMLVNRVSRFHVAQAAICGASKRNERVQIRQQELYTELDHNMVETKKYILKNRKDPDDMYDMPKFE

SEQ ID NO: 171 - DNA, 2367 bp, Leuconostoc mesenteroides
  misc_feature: PHK
atgaatatcgattcaacagattacctgaacaatttagatgcctactggcgagctaccaattatttgtcagttggacaactctatttgttagataacccattgcttaaggaaaagttaacggcagaacaagttaaaattcacccaatcgggcactggggcacgattcctagtcaaaactttatttatgcccatttaaatcgtgctattaataaatttaatttgaatatgttttacattgaggggcctggccatggcggacaagtaatgatttcaaatgcttatcttgatggtagttataccgaagcatttccagaaatcacacaggatgaagcgggtatgcagaaaatgtttaagcgtttctctttccccggtggcgttgcttcacatgctgatcctaaagtacctggatcgattcatgaaggtggtgctttaggctattctatcttgcacggtgctggtgctgtattggataatccagacctcattgctgcggttgttgttggcgatggtgaagcagaaacagcacccctagccacttcatggcatgttaataaatttttgaatcctaaaaatgatggtactgtattaccaattttgaatttaaatggcttcaagattgcgaatcccacagttctctctcgagaatctgatgaaacactaaccgattatttccacagtctgggatggcacccttactttgtaagttcttttgacaaaccgattatgcaagttcatgaagaaatggcaaaaaccatggacacagtatttactgagattaaagacattagagaaaaagccgttcagcagacaaatgaagagattacacgaccactttggccaatgattgttttacgttcacctaaaggctggacagggccaaaaacttgggatgacaaaccaattgaaaattcatttcgtgcacaccaaattccaattcctgctgaccaaaatcatcctgaatatataccacaacttgttgattggttacaatcttacaaaccagatgaattatttgatgaaaacggtcagttaacacaatctatccaagaagtattaccgaaaaaagagctacgtatggccaataattcggtcaccaatgctggtattatcaaacctttgattttacctgacattgacaattacttggtagaaaataatcagccagacaataacttagctcaagatgctattttgttaggtgactatttgcgtgatatcatcaaacttaatcctactaacttccgtggctttggcccagatgaaacagcttctaatcgtttccaagacatttttgaaacaactaatcgccaatggctattaccaatcaaagaacctaatgatcaattcatggcacctgaaggccgtattattgattctatgttatcagagcattatgatgaggggatgcttgaagcttatacgctaaccggtcgtcatggattctttgccagttatgaggtctttattcgtgaagttgatgacatgattgtgcaacattttaagtggttgaatcattctcatgacgtttcatggcgtaaggacgtaccggcattaaatattattgctgattcaaccgttttccaacaagaccataatggttactcacaccaagatcctggtgtaacaacaatgttgtatgaaaagcaaccagacttcattcgcgagttcttcccagcggatgctaatagcttggtcgcaacatttgaacatgctgcgcaagcaacgcaacagattaattatattgtggccagcaaacatccccgcttacagtggttctcacctactgaggccaaacagcttgttacgcagggattacgtgtcattgattgggcaagtactgacaaaggtgaaaaacctgatattattattacttcagctggttctgaaccaacgacagaaagtttagcagcaatacaaattttgcacgaacacataccatcattaaaaatacgttacatcaatgtattggatctatttaaactacgggccgatgccagctatggcttaagtgatgatgaatttgatgcttacttcactactgacacaccagtattatttgcattccatggctatgaaccaatgattgaatctattttcttcaaacgacacaatcaccacttagcagttcatggttaccgagaagttggtgacattacaacaccatttgatatgcgtgttcttaacaaaattgatcgatttaatttagttaaagctgctattaatctcttgccagaaaatattcgcaccaagcaagcagccctcgtgcaagaaatgaccgataagctcgacctacacgttgcgtatactaggtcaaagggaacggacttgcccgaagtagaagattggcgctggcgaccacttaagtga

SEQ ID NO: 172 - protein, 788 aa, Leuconostoc mesenteroides
  misc_feature: PHK
MNIDSTDYLNNLDAYWRATNYLSVGQLYLLDNPLLKEKLTAEQVKIHPIGHWGTIPSQNFIYAHLNRAINKFNLNMFYIEGPGHGGQVMISNAYLDGSYTEAFPEITQDEAGMQKMFKRFSFPGGVASHADPKVPGSIHEGGALGYSILHGAGAVLDNPDLIAAVVVGDGEAETAPLATSWHVNKFLNPKNDGTVLPILNLNGFKIANPTVLSRESDETLTDYFHSLGWHPYFVSSFDKPIMQVHEEMAKTMDTVFTEIKDIREKAVQQTNEEITRPLWPMIVLRSPKGWTGPKTWDDKPIENSFRAHQIPIPADQNHPEYIPQLVDWLQSYKPDELFDENGQLTQSIQEVLPKKELRMANNSVTNAGIIKPLILPDIDNYLVENNQPDNNLAQDAILLGDYLRDIIKLNPTNFRGFGPDETASNRFQDIFETTNRQWLLPIKEPNDQFMAPEGRIIDSMLSEHYDEGMLEAYTLTGRHGFFASYEVFIREVDDMIVQHFKWLNHSHDVSWRKDVPALNIIADSTVFQQDHNGYSHQDPGVTTMLYEKQPDFIREFFPADANSLVATFEHAAQATQQINYIVASKHPRLQWFSPTEAKQLVTQGLRVIDWASTDKGEKPDIIITSAGSEPTTESLAAIQILHEHIPSLKIRYINVLDLFKLRADASYGLSDDEFDAYFTTDTPVLFAFHGYEPMIESIFFKRHNHHLAVHGYREVGDITTPFDMRVLNKIDRFNLVKAAINLLPENIRTKQAALVQEMTDKLDLHVAYTRSKGTDLPEVEDWRWRPLK

SEQ ID NO: 173 - DNA, 2385 bp, Oenococcus oenii
  misc_feature: PHK
atgactattaattatgattcaaaggattatttgaaatatgttgatgcctattggcgggctgccaattatctttcagtcggtcaacttttcttgagaaacaatccgttacttaaagacgaacttcagtccaaagacgttaagatcaagccgatcggtcattggggaacggttgcgccgcagaattttatttatgctcatttaaatcgagcaattttaaaatacgatttaaatatgttttatattgaaggctctggccatggtggccaggtgatggtttccaattcatatttggatgggtcttataccgaaacttatccaaaagtaactcaggatattcaaggaatgcaacgtttattcaagcaattctcttttcctggcggaattgcttcacatgctgctccggaaactcctggatcgattcacgaaggaggagagctgggttattcgatttcgcatggagttggtgctattttggacaatcccgatgtgattgctgctgttgaaatcggggatggtgaatcagaaacggggcctttggccgcatcgtggttttccgacaaattcattaatccgattcatgatggtgctgtgttgccgattgttcagattaatggatttaaaatttccaatccaacaattctttctcgcatgagcgatcgtgatttgaccaattattatcatggaatgggttgggagcctttgttcgttgaaacggatggttcagataattttaaagtgcatgccgagatggccgatgctgttgataaggccattgaaaaaattaaagctattcaaaaaaacgcccgtaataataatgatgattcattgccaatctggccgatgattgtattacgtgctcctaaaggttggacaggtccaaaaaaagatttggatggtaatccgattgaaaattcatttcgggcacatcaggtgccgattccagtcgatgcaaatcatttggaacataaagatatgctgattgattggatgaagtcctacaaaccggaagaattgttcaatgaggatggcagcttaaaagaaattgttaaggtaaatcagccaaaaggccaacggcgaatggcaatgaacccaatcacgaatggtggaataaagccaaggacattgaatatgcctgatatggaacgatttgcttttccgaaaaatagcttgaaaaacaataaaaaaccagggatggaccttcaggttgtttcaacatttattgccgaaataataaagaaaaatcctatcaatttccgtcagttcggtcccgatgaaacaatgtccaatcgtctctgggacgagtttaaagtcactaatcgtcagtggatgcaagcagtccatgaaccaaatgatcaatatatggctcattctggtcgtattctagatgctcaattgtctgaacatcaggccgagggatggatggaaggatacgttttgaccggccgacacgctttctttgcgtcctacgaagcctttacgcgtgtaattgattcgatgctgactcaatattataagtggttgcgaaaagcggtcgagcaagattggcgtcacgattatccttcgttaaatgtcattaatgcttcacatgcttttcaacaggaccataatggttatactcatcaagatcccggtatgcttactcatatggctgaaaaaggtcatgagtttgtcaatgaattcttgccagccgatgctaattcccttttggcagttatgaataagtctctgcaggttagaaacaaaattaacattattgtcgcttccaaacacccacgaactcaatggtttacgatcgacgaagccaaggaattggttgacaacggtttgggaattattccatgggcttccaacgatgacggagtggaaccggacgttgtttttgcagccggtggaacggaagcgactatggaaagtttggctgctatttcgctcttgcatgaaagcttccctgaattgaagttccgctttattaatgtaatcgatttgttgaaactgcgcaaaaaaggggataacgatgattatcgcggtctaagcgatttggaattcgaccattactttacgcgtgaaaaaccagtagtcttttccttccacggctttgaaagtttggcacgcgacttgttctatgaccgccacaatcataatgttatttttcatggatatcgtgaaaacggagacattacaactccgttcgatatgcgtgtcctgaatcatcttgatcgtttccaccttgccaaagacgcaatcaacgcaactaagtacgctgatgtggctggccaatttgaccaacgaatggatgatatgttggccaaacataccgcttatatttgcgatcagggaacagacctgcctgaagtaacctcttggcagtggcaggatattaaataa

SEQ ID NO: 174 - protein, 794 aa, Oenococcus oenii
  misc_feature: PHK
MTINYDSKDYLKYVDAYWRAANYLSVGQLFLRNNPLLKDELQSKDVKIKPIGHWGTVAPQNFIYAHLNRAILKYDLNMFYIEGSGHGGQVMVSNSYLDGSYTETYPKVTQDIQGMQRLFKQFSFPGGIASHAAPETPGSIHEGGELGYSISHGVGAILDNPDVIAAVEIGDGESETGPLAASWFSDKFINPIHDGAVLPIVQINGFKISNPTILSRMSDRDLTNYYHGMGWEPLFVETDGSDNFKVHAEMADAVDKAIEKIKAIQKNARNNNDDSLPIWPMIVLRAPKGWTGPKKDLDGNPIENSFRAHQVPIPVDANHLEHKDMLIDWMKSYKPEELFNEDGSLKEIVKVNQPKGQRRMAMNPITNGGIKPRTLNMPDMERFAFPKNSLKNNKKPGMDLQVVSTFIAEIIKKNPINFRQFGPDETMSNRLWDEFKVTNRQWMQAVHEPNDQYMAHSGRILDAQLSEHQAEGWMEGYVLTGRHAFFASYEAFTRVIDSMLTQYYKWLRKAVEQDWRHDYPSLNVINASHAFQQDHNGYTHQDPGMLTHMAEKGHEFVNEFLPADANSLLAVMNKSLQVRNKINIIVASKHPRTQWFTIDEAKELVDNGLGIIPWASNDDGVEPDVVFAAGGTEATMESLAAISLLHESFPELKFRFINVIDLLKLRKKGDNDDYRGLSDLEFDHYFTREKPVVFSFHGFESLARDLFYDRHNHNVIFHGYRENGDITTPFDMRVLNHLDRFHLAKDAINATKYADVAGQFDQRMDDMLAKHTAYICDQGTDLPEVTSWQWQDIK

SEQ ID NO: 175 - DNA, 1107 bp, Neosartorya fischeri
  misc_feature: acetylxylanesterase
atgagagctttgtctgttttttttgctttgttctgtttcttggctttatcttctgcttctccaggtcaagatgttgttaaaagagttacttctggttctttgcaacaagttactaattttggttctaatccatctggtactttgatgtacatttacgttccaaagaatttggctactaaaccaggtattgttgttgctattcattattgtactggtactgctcaagcttattatactggttctccatatgctcaattggctgaacaatacggttttattgttatctatccacaatctccatattctggtacttgttgggatgtttcttctcaatctgctttaactcataatggtggtggtgattctaattctattgctaacatggttacttggactatttctcaatacaatgctgatacttctaaggtttttgttactggttcttcttctggtgctatgatgactaatgttatggctgctacttatccagaattgtttgctgctgctactgtttattctggtgtttctgctggttgtttttactcttcatctaaccaagttgatgcttggaactcttcttgtgctcaaggtaatgttatttctactccagaagtttggggaggtattgctaaagcaatgtatccaggttatactggtccaagaccaagaatgcaaatttatcatggttctactgatactactttgtacccacaaaattactacgaaacttgtaaacaatgggctggtgtttttggttacaattacaactctccacaatctactcaatctaatactccacaagctaattaccaaactactatttggggtccaaatttgcaaggtatttttgctactggtgttggtcatactgttccaattcatggtgaacaagatatggaatggtttggttttgcaggtggttcttctactactactacacaaccaactactacttctactacaacatcttctggtggttcttcaactggtactggtgttgctgctcattggggtcaatgtggtggtaatggttggactggtccaactgtttgtgcttctggttatacttgtactgttgttaatgcttggtattctcaatgcttataa

SEQ ID NO: 176 - protein, 368 aa, Neosartorya fischeri
  MISC_FEATURE: acetylxylanesterase
MRALSVFFALFCFLALSSASPGQDVVKRVTSGSLQQVTNFGSNPSGTLMYIYVPKNLATKPGIVVAIHYCTGTAQAYYTGSPYAQLAEQYGFIVIYPQSPYSGTCWDVSSQSALTHNGGGDSNSIANMVTWTISQYNADTSKVFVTGSSSGAMMTNVMAATYPELFAAATVYSGVSAGCFYSSSNQVDAWNSSCAQGNVISTPEVWGGIAKAMYPGYTGPRPRMQIYHGSTDTTLYPQNYYETCKQWAGVFGYNYNSPQSTQSNTPQANYQTTIWGPNLQGIFATGVGHTVPIHGEQDMEWFGFAGGSSTTTTQPTTTSTTTSSGGSSTGTGVAAHWGQCGGNGWTGPTVCASGYTCTVVNAWYSQCL

SEQ ID NO: 177 - DNA, 1101 bp, Pyrenophora tritici-repentis
  misc_feature: beta-xylosidase, HIS tagged
atgttgttgcaagcttttttgtttttgttggctggttttgctgctaaaatttctgctcatcatcaccaccaccacccaccttctccaccttctgatgatgatgacaaatccgttgctgtttatgatccaccagttattaacactttccatcaatgtgatccagctgctcatgtttggaaacatgatccaaatactgtttacgtttacggttctcatgatgttaattctactaagaatccaccagttcaatatgatatgaaggattactacgttttgattcaagttgatattactaaaccagctactgttggtccaaagattttggatttgccagatattccatgggcttctcaacaattgtgggctccagatgttgctgaaaaaaatggtgaatacttcttgtattttccagctaaagataaggatggtgtttttagaattggtgttgctaaatctgataaaccagacggtaaattcaaagctgaaccatcttatattccaggtgcttattctattgatccagctattttggctgatgatgatggttgttactacatgtattttggtggtttgtggggtggtcaattgcaagcttggccaaacaatactttgaatacttctgctttcggtaatatttctccatcttctggtccagctttgggtccaagatttgctaaattgtctgctaatatgacacatttggctactgaaccaaaagaattggttatctacgataaagatggtcaagttatgcaagctaattctactagaagatactttgaagctccatctattaacaaagttggtaacttgtattacttgcaatattctactggtacttctcatactattgaaattgctgttggtaaaaaaccagaaggtccattttattggaaatctaccttgttgcaaccagttaaaggttggactactcatgaatctattgttaagtttaagggtgattggttgttgtattatgctgatgcttctttgactggtattgatgatttgagaaacactaaggttagaaagttgaattttgctaatggtacttttgctttggctcaaccacaaccatatactccatttccatcttcataa

SEQ ID NO: 178 - protein, 366 aa, Pyrenophora tritici-repentis
  MISC_FEATURE: beta-xylosidase, HIS tagged
MLLQAFLFLLAGFAAKISAHHHHHHPPSPPSDDDDKSVAVYDPPVINTFHQCDPAAHVWKHDPNTVYVYGSHDVNSTKNPPVQYDMKDYYVLIQVDITKPATVGPKILDLPDIPWASQQLWAPDVAEKNGEYFLYFPAKDKDGVFRIGVAKSDKPDGKFKAEPSYIPGAYSIDPAILADDDGCYYMYFGGLWGGQLQAWPNNTLNTSAFGNISPSSGPALGPRFAKLSANMTHLATEPKELVIYDKDGQVMQANSTRRYFEAPSINKVGNLYYLQYSTGTSHTIEIAVGKKPEGPFYWKSTLLQPVKGWTTHESIVKFKGDWLLYYADASLTGIDDLRNTKVRKLNFANGTFALAQPQPYTPFPSS

SEQ ID NO: 179 - DNA, 984 bp, Aspergillus niger
  misc_feature: Endo-xylanase
atggttcagatcaaggtagctgcactggcgatgcttttcgctagccaggtactttctgagcccattgaaccccgtcaggcttcagtgagtattgataccaaattcaaggctcacgggaagaaatatcttggaaacattggtgatcagtacaccttgaccaagaactcgaagactccggccattatcaaggccgattttggcgcgttgactccagagaacagcatgaagtgggatgctactgaacccagccgtggacagttctctttctcaggatcggactacctggtcaactttgcccagtctaacaacaagctgatccgcggacatactctcgtgtggcactcgcagctcccctcctgggtccaatccatcacggacaagaatacactgatcgaagtcatgaagaatcacatcaccacagtgatgcaacactataagggcaagatttatgcctgggatgttgtcaatgaaatcttcaacgaagacggctccctacgcgacagcgtcttttacaaggtcatcggcgaggactacgtgcggatcgccttcgagactgctcgggctgcagatcccaatgcaaagctctacatcaatgattacaacctggattccgcctcctaccctaaattgaccggcatggttagccatgtcaagaagtggatcgcagctggcatccctatcgatggaatcggttcccaaacccacttgagcgctggtggaggtgctggaatttctggagctctcaatgctctcgcaggtgccggcaccaaggagattgctgtcaccgagcttgacatcgctggcgccagctcgaccgactacgtggaggtcgtcgaagcctgcctgaaccagcccaagtgtatcggtatcaccgtttggggagttgctgacccggattcctggcgctccagctccactcctctgctgttcgacagcaactacaacccgaagcctgcatacactgctatcgcaaatgctctctag

SEQ ID NO: 180 - protein, 327 aa, Aspergillus niger [sequence omitted]

SEQ ID NO: 181 - DNA, 1107 bp, Aspergillus fumigatus
  misc_feature: Acetyl esterase
atgcatcggtggcaattgcttctagggcttgtttttgcaatcgaagcagcttcagctcatccaagatcatggggtcctagaaagttcacaagtctggtttccttcggtgactcctacacagatcagtcaagactaaactactttggttctcataacggatctgcgccaccaataggctgggagcaaccagactctaacaatacagcatctgggggatacgtgtggggacattatgtcagtcagtacgctgacgtgaacttatacaattatgccgtgtctggcgcagtatgctctaatgaaatcacacctagaacttttagttcaatcaatgctcctttcccatctgtactggaatatgaggttagcgcatttttggctgattcaaaacacaaagtttccggtaagagatttttacacattccaccaagggagactgtctactctatatggattggcactaatgacctcggcaactacgctttcattacagattcccaagtcaaggataaaaccatccctgattacattaactgtgtttactcagttttagacagagtttatgtgtctggtggtagatactttgtactcatgaatctggccccattgcaattagctcctttgtacgcaactccagaaaatggtggggtaggcgctaatcattactggccagacaaaccagataacttaactctaacttcatatagaatgtgggaacaagttgcgactgtgaaccatgtttttcaataccaaaccccttacgaacttttggtcgctagaagatacccaggtgctcgttttgccgtcatggacatgtatggtttgttgtctgaagtctactataatccaacaaaatacttcaatggaagcgcacaggccaatgtaacagggtttaacaatcattgtaccttagatggcggtcaatgtacaagactaccaagtcctgattcattcatgtggttcgatgaacttcatccatcccaacgaacagatcaaatcattgccgaagagtttgttaaggttgtaggaggagattcaaagtgggccacgtattgggatgatgatgacaaaggtggttctcctccttctcatcatcaccaccaccactaa

SEQ ID NO: 182 - protein, 368 aa, Aspergillus fumigatus
  MISC_FEATURE: Acetyl esterase
MHRWQLLLGLVFAIEAASAHPRSWGPRKFTSLVSFGDSYTDQSRLNYFGSHNGSAPPIGWEQPDSNNTASGGYVWGHYVSQYADVNLYNYAVSGAVCSNEITPRTFSSINAPFPSVLEYEVSAFLADSKHKVSGKRFLHIPPRETVYSIWIGTNDLGNYAFITDSQVKDKTIPDYINCVYSVLDRVYVSGGRYFVLMNLAPLQLAPLYATPENGGVGANHYWPDKPDNLTLTSYRMWEQVATVNHVFQYQTPYELLVARRYPGARFAVMDMYGLLSEVYYNPTKYFNGSAQANVTGFNNHCTLDGGQCTRLPSPDSFMWFDELHPSQRTDQIIAEEFVKVVGGDSKWATYWDDDDKGGSPPSHHHHHH

SEQ ID NO: 183 - DNA, 3045 bp, Aspergillus oryzae
  misc_feature: alpha-glucuronidase
atgaagctgatttggcctacgtctcttctctttacggccctggtggcagccgaaccttacttgttattttcatctggcacctctgaataccaacttgcgtctaatactactgcaccagctgtttgggtagcgcaaaatgaaccagtaggcgtattaagagctgctcacgatctagccaacgattttggtagagttttgggtgtcaatggtactgttaatgttttcgacactgatatttctgagtcaccaggtaaagcagtaatcatcactggcacagtgggtcaatccacgccaatcgatcaacttgtttccgatgggaaactcgatgtgtccctgatagaaggaaagtgggaaagttatgtgtctcgtatcgttgaaaatccatttccaaacgtgacatggtcactcgttgtagctggttctgacagaagaggtacaatctacggcttgtacgatataagtgagcaaatgggtgtctctccttggtactggtgggcagacgtccctgttaagaccaaaacaggaatatgggtcgctccagaaggaactttccaaaagtcaccatctgtgaagtatagaggtttcttcatcaatgatgagagtcctgcattgtcaggatgggtggccgagaatttcggtaccaagtttaactctgccttctatagacatatctttgaattatgtttgagactgaagggaaactacctgtggccagctatgtgggggaaaatgttttatgtcgatgatgtcgataatggccaactcgcccatgaatacggtatcattatgggtacaagtcatcatgaaccaatggcacgatcagaacaggagcagaaaacgtacctggatggtgaatggaattggaacgaaaatcaagccaacattacaacatttttccaacaaggcattgatagagccaaacattgggatacaatatggactatgggaatgagaggtgaaggtgacgtggcttctcctacgttgactgctgccgatctggaagagttgattcacgcacaacaaaaattgttggtcgaatcattcaacgcctccgatcctgcaagtattccacaaacatgggtcctatacaaagaggtttcagactactacgccgctggcatggaagtccctgagtcagtcacactactttggacagatgataattcaggtaatctcatcagagttccaatagctaatgaaacatctagagttgcaggtgctggcgtatactaccactttgactacgttggttccccaaggtcttacaaatggataaactcaatacaattggttaagacctgggagcaaatgcatctagcataccaaaaatcagcaagacaaatctggattgcaaacgtgggggacatcaaaggtcttgaagtcccactcactcactttatggacatggcctatgacatggataggtttacgtctacagactcaacaacaaaatggttgaagcgttgggcagcgagagagtttaacgaaaggattgccgatagaacagctgatatcttaaaccactatggcacattagttgccagacgtaagtacgagctattgtcacaactgccattcgctttctctactatctactatgacgaagcagaggcgaatcttgctcaatgggagagtttacttgcccaaacacaatcagtctattcaagtttagatcaagctaccagaaccccatttttcgaaatgtttttacatcctgtcctagcgggtaaaactgtagtggatctgtatacaaaaacagcttttaatgcactctaccatcaacaaggtagaatatctacaaacagattagctcagaaggttcatgacttgtttacagaggacagtgccattacggaaagataccacggggtgaaaggagggaaatggaggcctgtcatggatcaggttcacatcggctactcaagctgggatgatccagttgataatacaaatgtaatgccagctctatcttacatcgccgctccacaaggagcgggtggaataggcattgcagttcagggttcagcagcttcctacccagagcaaaagacactaagacttttgtctatggacccttacatgccacctagtgaatccagatacattgatatctttgcaaggaaaaatacaacggtgacgtattcaattagctccaatactagctacgtgacagtatctaacgcttcaggcagtgtctctgcaagcagcaatatcagcgatgttagatccaccatcactgtagactgggcatccgcagaacctggactttcccataccgaactccaagtgagagccggagatggcttcactgctgctctagtacttccagtcaataatacttttgtcccaactaactttactggttttgtcgagtccaatggagttatctccatcgaagcgtcacattatacatccgctgaaacaaaatctaatgtatcatacgttgaaatccctcattatggtagaacattatcagcagttatgccttggccagttactatggggacacagcatcctaacactggaccagctttaagatactcattgtacactactacagcttctccaagcgctaggttgattatctccttgggagcatcacataaccatgatccaactagattgattaagttcgcttactcattagacgggtctgttcctgttactgttcgaccagtctcaactgtaccaccatacaaggaaggtcaggcttggcagcaggccgttatagaaaacggttggacctctgttattgaactaccaggtgaagtgggtactggagagcatgaattatctttatggttgcttgaacctggagttgtattacaaaagattgttttggacatgggagggtatcaagattctgcattagggagtcctgaacgtgctgtggttaccgaagctgacgtattgagagcggaagtcgttgaggaaggcagcgatatctcaccattgtctagagtctggagattgccatcttctcatgacttagatgatgatgacaaaggtggttctcctccttctcatcatcaccaccaccactaa

SEQ ID NO: 184 - protein, 1014 aa, Aspergillus oryzae
  MISC_FEATURE: alpha-glucuronidase
MKLIWPTSLLFTALVAAEPYLLFSSGTSEYQLASNTTAPAVWVAQNEPVGVLRAAHDLANDFGRVLGVNGTVNVFDTDISESPGKAVIITGTVGQSTPIDQLVSDGKLDVSLIEGKWESYVSRIVENPFPNVTWSLVVAGSDRRGTIYGLYDISEQMGVSPWYWWADVPVKTKTGIWVAPEGTFQKSPSVKYRGFFINDESPALSGWVAENFGTKFNSAFYRHIFELCLRLKGNYLWPAMWGKMFYVDDVDNGQLAHEYGIIMGTSHHEPMARSEQEQKTYLDGEWNWNENQANITTFFQQGIDRAKHWDTIWTMGMRGEGDVASPTLTAADLEELIHAQQKLLVESFNASDPASIPQTWVLYKEVSDYYAAGMEVPESVTLLWTDDNSGNLIRVPIANETSRVAGAGVYYHFDYVGSPRSYKWINSIQLVKTWEQMHLAYQKSARQIWIANVGDIKGLEVPLTHFMDMAYDMDRFTSTDSTTKWLKRWAAREFNERIADRTADILNHYGTLVARRKYELLSQLPFAFSTIYYDEAEANLAQWESLLAQTQSVYSSLDQATRTPFFEMFLHPVLAGKTVVDLYTKTAFNALYHQQGRISTNRLAQKVHDLFTEDSAITERYHGVKGGKWRPVMDQVHIGYSSWDDPVDNTNVMPALSYIAAPQGAGGIGIAVQGSAASYPEQKTLRLLSMDPYMPPSESRYIDIFARKNTTVTYSISSNTSYVTVSNASGSVSASSNISDVRSTITVDWASAEPGLSHTELQVRAGDGFTAALVLPVNNTFVPTNFTGFVESNGVISIEASHYTSAETKSNVSYVEIPHYGRTLSAVMPWPVTMGTQHPNTGPALRYSLYTTTASPSARLIISLGASHNHDPTRLIKFAYSLDGSVPVTVRPVSTVPPYKEGQAWQQAVIENGWTSVIELPGEVGTGEHELSLWLLEPGVVLQKIVLDMGGYQDSALGSPERAVVTEADVLRAEVVEEGSDISPLSRVWRLPSSHDLDDDDKGGSPPSHHHHHH

SEQ ID NO: 185 - DNA, 3021 bp, Aspergillus fumigatus
  misc_feature: alpha-glucuronidase
atgctactgtcagtacttctgactgtcagctgcgtggtaggagctgcacacgctctcggtcaggaaactattgttgctttcgatcaaactaaaggcgcgtacaagttggcaggtaaaaacacggcagcaggcgtcattttgttagatggagatgattggcctggtgttattagagcagctggtgacttggctgttgatttcggaagagttacaggaactaactttacaacaggtttgatcaatggaactactttacatgatcaatcaagcgtgagaggaaatagaggagtcattattgctggcacagtgggtagatccagattaattgattcacttgctgctagaggcaaaatcgatgtatctcaaaccaagggcaaatgggaagcatttcaaacagaagtggtatctaatccattagaaggtatcccaaatgctgttgtaatctccgggagtgacaagaggggagtaatctacggtctttatgacatatctgagcaaattggcgtttctccttggtactggtttgcagatgttgctcctgcacaacataaagaggtttacgctctgaaaaagaagaagatccaaggaccaccatctgtcaaatacagaggtatcttcattaacgatgaacagccagcgttgacgaactggattaacgaaaattacccaccagccagatatggtccaggtttcaacgcagatttttactctcgtgtttttgaacttctgttaagattaagagcgaattacttatggccagctatgtggaataatgcgttttaccctgacgaccctagaaatggtccaacagcagacgaatatggtatagtcatgggaacgtcacacacagaaccaatgatgagagccactaaagagcaatccctatttctagaaggagaatgggattggacctccaatcagaaaaacattacacagtttttcaaggaaggtgcaattaggtcaaaagattgggaagtgctttggaccttgggcatgagaggtaagcacgatacggctaatcctactaatacaaaacaaactctgggagatatcgtcaacacacaacaacaaatactctcagatgtcttaaacatgacaaacatcagttctattccacaaatgtggtgtctctataaggaggttggacaattttacgaggagggtttacgtgcccctgatgatgttactttgttgtgggctgatgacaattgggggaatatacagagactacctctcgggaatgaaaccgctcgttctggtggtgcaggtgtgtactaccattttgattatgttggtgatcctagagattataagtggatcaatactatctcattgcaaaagacatgggaacaaatgcatcttgcttacgaaagacaagcaagacaaatttggatagtcaatatcggggatctaaaaggtgtggagctaccattgaaccatttcctggacctagcttacaatacacctttgtggtcatctccagattctaccctaacatggctaaaccattgggccactagggaatttggaacccaagtatcttctaaagtagccgacatcatggatcgttacgggatgtacgctgccagaaggaagtacgaactcatcgattcatctaccttcagtgtcatcaactataacgaagccgatagagtacaggaagagtggagagcattggttaatgatgctcaaaatgtttaccaagagttgaaagactcagctaggccagcattctttgaattagttttacaaccttgtatggcgggtcaaatagtgaccaacatccatatcacagtggctagaaataacctgtacgctggccaacgtagaacgtcaactaacaccttggctgatcaagctcttaaactgtttaatgacgaccatgccttgacacaaagatatcataagttgttagacggcaaatggaatcatattatggatcaaacgcacctaggatacgattactggcagcagccaatgagaaatacattgccaccactcgcatatactcaagtactggaggaatcattagctggctcaatgggtgtctcagtcgaagcatctaatgcctctgtgccaggtgacgatgtgtggcatagcctttctagtaactctctaactctaccaccaatggacccttacggcccatctacaagatggatggacatatactccagaggtacccatgagttcactttcaccgtaagtccttatgactcttgggtcaaagcaacaccatcctctggcaaaataagtgtgagtgggaataataccgatgcgagaatccatctcagtgttgattgggaaaaggttccaagtggctcacacatggccctgatcaatgtcactatctcttcagatgattacgggaatttcggtatgccaactgtacaacttcctgtaaacaaaactagcgttcctgccgactttcatggcttcgtggaatcagacggtacagtttcaatagaagccgagcacgctactagaaacacatcaagcacagacgtaagttacgcagtaattcctagatacggccatacattgtccggtgttacactgttgccagtcacaattgagacacagcaaccaccttcatcccctcgtttggaatacgacatgtatctgttttcaaatgtgagtacagttaaggccactgtctacctaggcccatcccttaatactgatcactcaagaccactgaaatatgctatttctatcaacgatgccgatcctcaggttgttcagtttgttccatctactccactcggctctttgccatctaactgggaaactactgtgagaaatgccgtttggacaaatacaacatcccatgctatacaaggtggaggcaggaaaaatacccttaagttgtgggcaattgaaccaggagtggtttttcagaaaattgttgttgaccttggcggagttagaccatcctacttagggccaccagagtctatgatcgtagatgatgatgacaaaggtggttctcctccttctcatcatcaccaccaccactaa

SEQ ID NO: 186 - protein, 1006 aa, Aspergillus fumigatus
  MISC_FEATURE: alpha-glucuronidase
MLLSVLLTVSCVVGAAHALGQETIVAFDQTKGAYKLAGKNTAAGVILLDGDDWPGVIRAAGDLAVDFGRVTGTNFTTGLINGTTLHDQSSVRGNRGVIIAGTVGRSRLIDSLAARGKIDVSQTKGKWEAFQTEVVSNPLEGIPNAVVISGSDKRGVIYGLYDISEQIGVSPWYWFADVAPAQHKEVYALKKKKIQGPPSVKYRGIFINDEQPALTNWINENYPPARYGPGFNADFYSRVFELLLRLRANYLWPAMWNNAFYPDDPRNGPTADEYGIVMGTSHTEPMMRATKEQSLFLEGEWDWTSNQKNITQFFKEGAIRSKDWEVLWTLGMRGKHDTANPTNTKQTLGDIVNTQQQILSDVLNMTNISSIPQMWCLYKEVGQFYEEGLRAPDDVTLLWADDNWGNIQRLPLGNETARSGGAGVYYHFDYVGDPRDYKWINTISLQKTWEQMHLAYERQARQIWIVNIGDLKGVELPLNHFLDLAYNTPLWSSPDSTLTWLNHWATREFGTQVSSKVADIMDRYGMYAARRKYELIDSSTFSVINYNEADRVQEEWRALVNDAQNVYQELKDSARPAFFELVLQPCMAGQIVTNIHITVARNNLYAGQRRTSTNTLADQALKLFNDDHALTQRYHKLLDGKWNHIMDQTHLGYDYWQQPMRNTLPPLAYTQVLEESLAGSMGVSVEASNASVPGDDVWHSLSSNSLTLPPMDPYGPSTRWMDIYSRGTHEFTFTVSPYDSWVKATPSSGKISVSGNNTDARIHLSVDWEKVPSGSHMALINVTISSDDYGNFGMPTVQLPVNKTSVPADFHGFVESDGTVSIEAEHATRNTSSTDVSYAVIPRYGHTLSGVTLLPVTIETQQPPSSPRLEYDMYLFSNVSTVKATVYLGPSLNTDHSRPLKYAISINDADPQVVQFVPSTPLGSLPSNWETTVRNAVWTNTTSHAIQGGGRKNTLKLWAIEPGVVFQKIVVDLGGVRPSYLGPPESMIVDDDDKGGSPPSHHHHHH

SEQ ID NO: 187 - DNA, 2685 bp, Saccharomycopsis fibuligera
  misc_feature: beta-glucosidase
atggtctccttcacctccctcctcgccggcgtcgccgccatctcgggcgtcttggccgctcccgccgccgaggtcgaatccgtggctgtggagaagcgctcgcgagtcccaattcaaaactatacccagtctccatcccagagagatgagagctcccaatgggtgagcccgcattattatccaactccacaaggtggtaggctccaagacgtctggcaagaagcatatgctagagcaaaagccatcgttggccagatgactattgttgaaaaggtcaatttgaccactggtaccggttggcaattagatccatgtgttggtaataccggttctgttccaagattcggcatcccaaacctttgcctacaagatgggccattgggtgttcgattcgctgactttgttactggctatccatccggtcttgctactggtgcaacgttcaataaggatttgtttcttcaaagaggtcaagctctcggtcatgagttcaacagcaaaggtgtacatattgcgttgggccctgctgttggcccacttggtgtcaaagccagaggtggcagaaatttcgaagcctttggttccgacccatatctccaaggtactgctgctgctgcaaccatcaaaggtctccaagagaataatgttatggcttgtgtcaagcactttattggtaacgaacaagaaaagtacagacagccagatgacataaaccctgccaccaaccaaactactaaagaagctattagtgccaacattccagacagagccatgcatgcgttgtacttgtggccatttgccgattcggttcgagcaggtgttggttctgttatgtgctcttataacagagtcaacaacacttacgcttgcgaaaactcttacatgatgaaccacttgcttaaagaagagttgggttttcaaggctttgttgtttcggactggggtgcacaattaagtggggtttatagcgctatctcgggcttagatatgtctatgcctggtgaagtgtatgggggatggaacaccggcacgtctttctggggtcaaaacttgacgaaagctatttacaatgagactgttccgattgaaagattagatgatatggcaaccaggatcttggctgctttgtatgctaccaatagtttcccaacagaagatcaccttccaaatttttcttcatggacaacgaaagaatatggcaataaatattatgctgacaacactaccgagattgtcaaagtcaactacaatgtggacccatcaaatgactttacggaggacacagctttgaaggttgctgaggaatctattgtgcttttaaaaaatgaaaacaacactttgccaatttctcccgaaaaggctaaaagattactattgtcgggtattgctgcaggccctgatccgataggttatcagtgtgaagatcaatcttgcacaaatggcgctttgtttcaaggttggggttctggcagtgttggttctccaaaatatcaagtcactccatttgaggaaatttcttatcttgcaagaaaaaacaagatgcaatttgattatattcgggagtcttacgacttagctcaagttactaaagtagcttccgatgctcatttgtctatagttgttgtctctgctgcaagcggtgagggttatataaccgttgacggtaaccaaggtgacagaaaaaatctcactttgtggaacaacggtgataaattgattgaaacagttgctgaaaactgtgccaatactgttgttgttgttacttctactggtcaaattaattttgaaggctttgctgatcacccaaatgttaccgcaattgtctgggccggcccattaggtgacagatccgggactgctatcgccaatattctttttggtaaagcgaacccatcaggtcatcttccattcactattgctaagactgacgatgattacattccaattgaaacctacagtccatcgagtggtgaacctgaagacaaccacttggttgaaaatgacttgcttgttgactatagatattttgaagagaagaatattgagccaagatacgcatttggttatggcttgtcttacaatgagtatgaagttagcaatgcaaaggtctcggcagccaaaaaagttgatgaggagttgcctgaaccagctacctacttatcggagtttagctatcaaaatgcaaaagacagcaaaaatccaagtgatgcttttgctccagcagatttaaacagagttaatgagtacctttatccatatttagatagcaatgttaccttaaaagacggaaactatgagtatcctgatggctacagcactgagcaaagaacaacacctaaccaacctgggggcggcttgggaggcaacgatgctttgtgggaggtcgcttataactccactgataagtttgttccacagggtaactccactgataagtttgttccacagttgtatttgaaacaccctgaggatggcaagtttgaaacccctattcaattgagagggtttgaaaaggttgagttgtccccgggtgagaagaagacagttgatttgaggcttttgagaagagatcttagtgtgtgggataccaccagacagtcttggatcgttgaatctggtacttatgaggccttaattggcgttgctgttaatgatatcaagacatctgtcctgtttactatttga

SEQ ID NO: 188 - protein, 894 aa, Saccharomycopsis fibuligera
  MISC_FEATURE: beta-glucosidase
MVSFTSLLAGVAAISGVLAAPAAEVESVAVEKRSRVPIQNYTQSPSQRDESSQWVSPHYYPTPQGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYYADNTTEIVKVNYNVDPSNDFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEYEVSNAKVSAAKKVDEELPEPATYLSEFSYQNAKDSKNPSDAFAPADLNRVNEYLYPYLDSNVTLKDGNYEYPDGYSTEQRTTPNQPGGGLGGNDALWEVAYNSTDKFVPQGNSTDKFVPQLYLKHPEDGKFETPIQLRGFEKVELSPGEKKTVDLRLLRRDLSVWDTTRQSWIVESGTYEALIGVAVNDIKTSVLFTI

SEQ ID NO: 189 - DNA, 1389 bp, Trichoderma reesei
  misc_feature: alpha-galactosidase
atgacaccacacagcatcgatagagccgcaagaccttccgtatggtctggtctagccttattacttagtacggcccacgccatagtgatgcctgatggagttacaggtaaagtgccatcattgggttggaatagttggaatgcctaccactgcgatatagacgaatctaagtttttgtctgccgctgaagtaattgtttcctccggtttgttagatgctggatacaattacgtgaatatcgatgattgctggtcaatgaaggacgggagagttgatggtcatatagcggttaatacaacaagatttccagatggaattgatgggttagcgaaaaaggttcatgacttgggactgaagctaggcatctactctacagctggaactgctacttgtgctgggtatcctgcttctcttggttatgaagatgtagatgcagccgactttgcagactggggagtagactacttgaagtacgacaattgtaatgtgccttctgattggcaggatgaatatgttgcttgcgcaccagacgctgtccaaacgggtccaaacggcacctgttctactgccttggaaccaaatcttgcaccaccaggttatgattggtctacctcaaaatcagctgaacgattcaatgctatgcgtaacgcattagcaaaacagtctagggaaatcgtcttgtcactgtgtatttggggcgtcgcggatgtattttcctggggtaatgaaacaggaatatcttggagaatgtcaggtgatattagtccagaatggggctcagtgactcatatcatcaacatgaattcctttaagatgaactcagtcggattttgggggcacaacgacgctgatattttggaagttggtaatggtaacctcactgcagctgagactagaactcatttcgcattgtgggctgcaatgaaatcacctctactaattggcactgacttagctcaactgtctcaagagaacattgagctacttaaaaacaagcatctcttagccttcaaccaagattcagtttacggtcaaccagccactccttacaaatggggcgtcaatccagactggacattcaactacaccaatcctgcagaatattgggctggtccaagctctaaaggccatctcgtgcttatgatgaatacactagatcatacagtcagaaaagaggcaaaatggagtgagatccctggcctgtctgcaggtagatacgaagtaagagatgtttggaccgataaaagcttgggttgtttgtctagttacaagacagcggttgctgctcatgatacagcagttatcttagtcgggaaaaagtgtcgtaactgggatgatgatgatgacaaaggtggttctcctccttctcatcatcaccaccaccactaa

SEQ ID NO: 190 - protein, 462 aa, Trichoderma reesei
  MISC_FEATURE: alpha-galactosidase
MTPHSIDRAARPSVWSGLALLLSTAHAIVMPDGVTGKVPSLGWNSWNAYHCDIDESKFLSAAEVIVSSGLLDAGYNYVNIDDCWSMKDGRVDGHIAVNTTRFPDGIDGLAKKVHDLGLKLGIYSTAGTATCAGYPASLGYEDVDAADFADWGVDYLKYDNCNVPSDWQDEYVACAPDAVQTGPNGTCSTALEPNLAPPGYDWSTSKSAERFNAMRNALAKQSREIVLSLCIWGVADVFSWGNETGISWRMSGDISPEWGSVTHIINMNSFKMNSVGFWGHNDADILEVGNGNLTAAETRTHFALWAAMKSPLLIGTDLAQLSQENIELLKNKHLLAFNQDSVYGQPATPYKWGVNPDWTFNYTNPAEYWAGPSSKGHLVLMMNTLDHTVRKEAKWSEIPGLSAGRYEVRDVWTDKSLGCLSSYKTAVAAHDTAVILVGKKCRNWDDDDDKGGSPPSHHHHHH

SEQ ID NO: 191 - DNA, 1365 bp, Trichoderma reesei (beta-mannase)
atgatgatgctctcaaagagtctcctttccgctgcaactgcagcctcagcgctggccgcggtactgcagcctgttccacgtgcttcgagctttgtaaccatatccggcacccaattcaacatcgatggcaaagtaggctactttgcgggcaccaactgctactggtgctcgttcctgaccaaccacgccgacgttgattccacctttagccacatctcttcctctggcctcaaggtagtccgtgtatggggcttcaacgacgtcaacacgcagccctctcccggccagatctggttccagaagctgtccgctacggggtctacgatcaacacgggagctgatgggctgcagactctcgactacgtagtccagtcagccgagcagcacaacctcaagctcatcatcccgttcgtcaacaactggagcgactacggcgggataaacgcctatgtcaacgcctttggcggcaatgcgaccacctggtacactaacacggccgcgcaaactcagtaccgcaagtacgtccaggccgtcgtcagccgctacgcaaactcgacggccatctttgcgtgggagctgggcaacgagcctcgctgcaacgggtgcagtactgatgtgattgttcagtgggcgacgagtgtgtcccaatatgtcaagtcacttgattcgaaccatctcgtgacgcttggagacgaggggctcggtctcagtactggagacggcgcttatccgtatacttatggcgagggcactgattttgccaagaatgtacaaatcaagtcgcttgactttggtactttccacctctatccggactcttggggaacaaactacacttggggcaatggctggattcagactcatgccgccgcttgtttagcagcaggcaaaccttgcgtgtttgaagaatacggcgcacagcaaaacccctgcaccaacgaggcaccctggcaaacaacctctctcacgactcgcggcatgggtggcgacatgttttggcagtggggagacacttttgccaacggtgcccagtcgaacagtgacccgtacaccgtctggtacaactcatcgaactggcaatgcttggtcaagaaccacgttgatgctattaacggcggtacaaccactcctcctcccgtatcatcgacgacgacaacctcgtctaggacctcgtcgacgcctccaccgcctgggggcagctgctcgcccttgtatggccagtgtggaggttctggatacactggtcccacgtgctgtgcgcagggaacttgtatatattccaactactggtactcgcaatgcctgaatacagatgatgatgacaaaggtggttctcctccttctcatcatcaccaccaccactga

SEQ ID NO: 192 - protein, 454 aa, Trichoderma reesei
  MISC_FEATURE: beta-mannase
MMMLSKSLLSAATAASALAAVLQPVPRASSFVTISGTQFNIDGKVGYFAGTNCYWCSFLTNHADVDSTFSHISSSGLKVVRVWGFNDVNTQPSPGQIWFQKLSATGSTINTGADGLQTLDYVVQSAEQHNLKLIIPFVNNWSDYGGINAYVNAFGGNATTWYTNTAAQTQYRKYVQAVVSRYANSTAIFAWELGNEPRCNGCSTDVIVQWATSVSQYVKSLDSNHLVTLGDEGLGLSTGDGAYPYTYGEGTDFAKNVQIKSLDFGTFHLYPDSWGTNYTWGNGWIQTHAAACLAAGKPCVFEEYGAQQNPCTNEAPWQTTSLTTRGMGGDMFWQWGDTFANGAQSNSDPYTVWYNSSNWQCLVKNHVDAINGGTTTPPPVSSTTTTSSRTSSTPPPPGGSCSPLYGQCGGSGYTGPTCCAQGTCIYSNYWYSQCLNTDDDDKGGSPPSHHHHHH

SEQ ID NO: 193 - DNA, 1178 bp, Neosartorya fischeri
  misc_feature: endo-beta-mannanase/mannosidase
atgaagttctccttcctcaccgtggccagcttcctcatagggcaagtagccctggccgctttgtcagctaaaaagttcgccagtgcatctgatctacaattcacaatagacgggaaaaccggttactttgcaggttctaattcatactggattgggtttttaactaataacgcagatgttgatctagtgtttgatcacatgaaggagtcaggcttgaagatcctgcgtgtatggggctttaatgacgtaaacacagtaccagggcaaggaacagtgtattaccaagtccatgctaatggtaagtcaacaatcaacacaggcgctgacggtttacaaagattggattacgttgtccattccgctgagaaaagaggcatcaaattgattatcaactttgttaataactgggatgattatgggggcatgaatgcttacgtgaaggcctatggcgaaactgatcataatgcattttactctaacaaaaatatacagaatgcctacaggagatatgttaaggcagtagtttctagatacaccaatagtccagcggtctttgcctgggaactagctaatgaacctagatgtaaaggttgtgacaccgaagttttatacgaatggattaagtctacttccgaatacatcaaaaagttagataaaagacacatggtctgcattggagatgaaggatttggtcttgatctgttgagcgacggttcatacccatacacttatgttgaaggttccaactttacgagaaaccttgcaataccaacaatcgattttggtacttttcatttgtacccagactcctggggtacaacacatgaatggggcaatggctgggctcaatctcatggagcagcttgcaaagcagctggtaaaccatgcctattcgaggaatatggtgttacatctaatcattgtgctttagaaactccttggcagaaaacatcacttaatacgactggagtcagtggagacttgtactggcaatacggagacactttatctactggacaatcaccaaacgatggtaacactatctactatggcacagatgagttcaaatgtattgttaaggatcatgttgcagctattaaggcgaaacagggttgggtggatgatgatgacaaaggtggttctcctccttctcatcatcaccaccaccacgtgtttaa

SEQ ID NO: 194 - protein, 390 aa, Neosartorya fischeri
  MISC_FEATURE: endo-beta-mannanase/mannosidase
MKFSFLTVASFLIGQVALAALSAKKFASASDLQFTIDGKTGYFAGSNSYWIGFLTNNADVDLVFDHMKESGLKILRVWGFNDVNTVPGQGTVYYQVHANGKSTINTGADGLQRLDYVVHSAEKRGIKLIINFVNNWDDYGGMNAYVKAYGETDHNAFYSNKNIQNAYRRYVKAVVSRYTNSPAVFAWELANEPRCKGCDTEVLYEWIKSTSEYIKKLDKRHMVCIGDEGFGLDLLSDGSYPYTYVEGSNFTRNLAIPTIDFGTFHLYPDSWGTTHEWGNGWAQSHGAACKAAGKPCLFEEYGVTSNHCALETPWQKTSLNTTGVSGDLYWQYGDTLSTGQSPNDGNTIYYGTDEFKCIVKDHVAAIKAKQGWVDDDDKGGSPPSHHHHHH

SEQ ID NO: 195 - DNA, 1380 bp, Aspergillus fumigatus
  misc_feature: Endoglucanase (EG1)
atgttgttgcaagcttttttgtttttgttggctggttttgctgctaaaatttctgctcaacaaccagctgcttcttctgctggtaatccaaaattgactacttacaagtgtactactgcaggtggttgtgttgctcaagatacttctgttgttttggattggggttatcattggattcatactgttgatggttatacttcttgtactacttcttctggtgttgattctactttgtgtccagatgctgctacttgtgctaaaaactgtgttattgaaccagctaattatacatctgctggtgttactacttctggtgattctttgacaatgtaccaatacgttcaatctaatggtgtttacactaatgcttctccaagattgtatttgttgggtccagataaaaactacgtcatgttgaagttgttgggtcaagaattgacttttgatgttgatttgtctactttgccatgtggtgaaaatggtgctttgtatttgtctgaaatgtctgctactggtggtagaaatgaatacaatactggtggtgctgaatatggttctggttattgtgatgctcaatgtccagttattgcttggaaaaatggtactttgaatacatctggtgcttcatattgttgtaacgaaatggatattttggaagctaattctagagctaattcttatactccacatccatgttctgctactgattgtgataaaggtggttgtggttttaatccatatgctttgggtcaaaaatcttattggggtccaggtggtactgttgatacttctaagccattcactattactactcaattcattacaaacgatggtactactactggtactttgtcagaaattagaagacaatacatgcaaaacggtaaggttattgctaatgctgtttcttctacaggtgttaactctattactgaagattggtgtacttcagttgatggttctgctgctacttttggtggtttgactactatgggtaaagctttgggtagaggtatggttttgattttctctatttggaatgatgcttctggttttatgaattggttggattctggtaatgctggtccatgttcttctacagaaggtaatccagatttgattaaggctcaaaatccaactactcatgttgttttctcaaatattagatggggtgatattggttctacttttaaaggttctgatggttctgttactactactacttctacaacttctactaagactactacatctactgctccaggtccaactcaaactcattatggtcaatgtggtggtcaaggttggactggtccaactgcttgtgcttctccatatacttgtcaagttttgaatccatggtactctcaatgcttataa

SEQ ID NO: 196 - protein, 459 aa, Aspergillus fumigatus
  MISC_FEATURE: Endoglucanase (EG1)
MLLQAFLFLLAGFAAKISAQQPAASSAGNPKLTTYKCTTAGGCVAQDTSVVLDWGYHWIHTVDGYTSCTTSSGVDSTLCPDAATCAKNCVIEPANYTSAGVTTSGDSLTMYQYVQSNGVYTNASPRLYLLGPDKNYVMLKLLGQELTFDVDLSTLPCGENGALYLSEMSATGGRNEYNTGGAEYGSGYCDAQCPVIAWKNGTLNTSGASYCCNEMDILEANSRANSYTPHPCSATDCDKGGCGFNPYALGQKSYWGPGGTVDTSKPFTITTQFITNDGTTTGTLSEIRRQYMQNGKVIANAVSSTGVNSITEDWCTSVDGSAATFGGLTTMGKALGRGMVLIFSIWNDASGFMNWLDSGNAGPCSSTEGNPDLIKAQNPTTHVVFSNIRWGDIGSTFKGSDGSVTTTTSTTSTKTTTSTAPGPTQTHYGQCGGQGWTGPTACASPYTCQVLNPWYSQCL

SEQ ID NO: 197 - DNA, 2637 bp, Aspergillus aculeatus
  misc_feature: beta-glucosidase, HIS tagged
atgatgaagctcagttggcttgaggcggctgccttgacggctgcttcagtcgtcagcgctgatgaattagccttttccccaccattttacccatctccttgggctaatggacaaggcgaatgggccgaagcataccagagagccgttgctattgttagtcagatgacacttgatgaaaaagtgaatttgactacaggtacggggtgggaattagaaaagtgtgtaggtcaaactggtggagttccaagattaaacatcggagggatgtgcttacaagatagtccactaggtatcagagattctgattacaattctgcttttcctgcaggcgttaatgttgccgcaacgtgggacaaaaacttagcctacctaagaggtcaagctatgggtcaggaattttcagataagggcatcgatgtccaattaggcccagccgcaggaccattgggacgatctccagatggtgggagaaactgggagggattctcacctgaccctgcacttactggtgttctgtttgcagaaactatcaaaggtatacaagacgccggtgttgttgcgacagctaaacactacattttgaatgaacaagagcattttagacaagtggctgaggccgctgggtacggtttcaacatatccgatacaatctcatcaaatgtggacgacaagacgattcatgagatgtatttgtggccatttgctgatgcagtgagagcaggcgttggggctataatgtgcagctacaatcaaatcaataatagttatggctgtcaaaactcatacactctcaataagttattgaaggctgaactgggtttccaaggtttcgtaatgtcagattggggtgcccatcactccggtgtcggttctgctttagctggtcttgacatgtctatgcctggtgacattacatttgactccgcaacatctttctggggaacaaatctgacaattgccgtccttaacggcaccgtgccacagtggagagttgacgacatggcagtccgtattatggctgcatattacaaagtcggccgtgaccgactgtaccaaccaccaaacttcagctcctggactagagatgaatacggctttaagtacttttatccacaggagggaccatacgaaaaagttaatcactttgtcaatgtccagaggaatcattccgaagtcatcagaaagctaggtgcagattctacagttttgttgaaaaacaataacgcattgcctttaacaggtaaagagcgaaaggttgccatcttgggtgaagatgcgggttctaatagttacggagccaatgggtgttcagatagaggctgcgataacggtactttagcaatggcctggggatcaggcacagctgaatttccataccttgtgacacctgaacaagcaatccaagctgaagtattgaaacataaagggtcagtttatgctataaccgacaattgggcattgtctcaagtcgaaaccctcgcaaaacaagcctctgttagtttggtttttgtgaatagtgatgctggtgaagggtacatttcagttgatggaaacgaaggcgatagaaataacctcacattgtggaaaaatggcgataatcttattaaggctgctgcgaacaattgtaacaatactattgtggttatccattctgtagggcctgtccttgttgacgaatggtacgaccatccaaatgtgacagctatactatgggcaggcttaccaggtcaagagtctggaaattccttagcagatgtactctacggacgtgtcaatcctggagctaagtctccattcacatggggtaagactagagaggcttacggagattacttagtaagagaattgaacaatggcaacggtgcgccacaagatgatttctctgaaggtgtttttatcgattatagagggttcgacaagagaaacgagactccaatctacgagtttggtcatggtttgagttatacaacttttaactactcagggcttcatattcaagtactaaacgcatcttctaacgcccaagtagcaacggaaactggcgcagctccaactttcggtcaggtgggtaatgcctcagattatgtttatccagaaggcctcacaaggatttcaaagttcatatacccttggctaaactctacagatttgaaagcatcatccggtgatccatactatggtgttgatactgcagaacatgtgcctgaaggcgctactgacggatcaccacaacctgttctgcctgctggaggtggttcaggagggaaccctagactctatgatgagttaattagggtatctgttactgtgaaaaacacagggagagtggcgggtgatgccgtgcctcaactatacgtgtctcttggaggaccaaatgaaccaaaagtagttttgagaaaattcgacagattaacattgaaaccatccgaggaaactgtttggactactaccctgacccgtagagatttgtctaattgggacgtagctgcccaagattgggtcatcacaagttaccctaagaaagtacatgttggctctagttccagacaacttccattacacgctgccctgccaaaagtgcaagatgatgatgacaaaggtggttctcctccttctcatcatcaccaccaccactaa

SEQ ID NO: 198 - protein, 878 aa, Aspergillus aculeatus
  MISC_FEATURE: beta-glucosidase, HIS tagged
MMKLSWLEAAALTAASVVSADELAFSPPFYPSPWANGQGEWAEAYQRAVAIVSQMTLDEKVNLTTGTGWELEKCVGQTGGVPRLNIGGMCLQDSPLGIRDSDYNSAFPAGVNVAATWDKNLAYLRGQAMGQEFSDKGIDVQLGPAAGPLGRSPDGGRNWEGFSPDPALTGVLFAETIKGIQDAGVVATAKHYILNEQEHFRQVAEAAGYGFNISDTISSNVDDKTIHEMYLWPFADAVRAGVGAIMCSYNQINNSYGCQNSYTLNKLLKAELGFQGFVMSDWGAHHSGVGSALAGLDMSMPGDITFDSATSFWGTNLTIAVLNGTVPQWRVDDMAVRIMAAYYKVGRDRLYQPPNFSSWTRDEYGFKYFYPQEGPYEKVNHFVNVQRNHSEVIRKLGADSTVLLKNNNALPLTGKERKVAILGEDAGSNSYGANGCSDRGCDNGTLAMAWGSGTAEFPYLVTPEQAIQAEVLKHKGSVYAITDNWALSQVETLAKQASVSLVFVNSDAGEGYISVDGNEGDRNNLTLWKNGDNLIKAAANNCNNTIVVIHSVGPVLVDEWYDHPNVTAILWAGLPGQESGNSLADVLYGRVNPGAKSPFTWGKTREAYGDYLVRELNNGNGAPQDDFSEGVFIDYRGFDKRNETPIYEFGHGLSYTTFNYSGLHIQVLNASSNAQVATETGAAPTFGQVGNASDYVYPEGLTRISKFIYPWLNSTDLKASSGDPYYGVDTAEHVPEGATDGSPQPVLPAGGGSGGNPRLYDELIRVSVTVKNTGRVAGDAVPQLYVSLGGPNEPKVVLRKFDRLTLKPSEETVWTTTLTRRDLSNWDVAAQDWVITSYPKKVHVGSSSRQLPLHAALPKVQDDDDKGGSPPSHHHHHH

SEQ ID NO: 199 - DNA, 744 bp, Saccharomyces cerevisiae PE-2
  misc_feature: FDH1
atggccacaattttggttttgataagaaactataatggtggtcatcaacaagcaattaatggtgagtgggatattgccggcgtggctaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctggatgctcaaaagaggtacgctcagggagtaaagaacatcctaaatagttacttttccaaaaagtttgattaccgtccacaggatattattgtgcagaatggttcttatgccaccagagcttatggacagaagaaataa

SEQ ID NO: 200 - protein, 247 aa, Saccharomyces cerevisiae PE-2
  MISC_FEATURE: FDH1
MATILVLIRNYNGGHQQAINGEWDIAGVAKNEYDLEDKIISTVGAGRIGYRVLERLVAFNPKKLLYYDYQELPAEAINRLNEASKLFNGRGDIVQRVEKLEDMVAQSDVVTINCPLHKDSRGLFNKKLISHMKDGAYLVNTARGAICVAEDVAEAVKSGKLAGYGGDVWDKQPAPKDHPWRTMDNKDHVGNAMTVHISGTSLDAQKRYAQGVKNILNSYFSKKFDYRPQDIIVQNGSYATRAYGQKK

SEQ ID NO: 201 - DNA, 1132 bp, Saccharomyces cerevisiae S288C
  misc_feature: FDH2
atgtcgaagggaaaggttttgctggttctttatgaaggtggtaagcatgctgaagagcaggaaaagttattggggtgtattgaaaatgaacttggtatcagaaatttcattgaagaacagggatacgagttggttactaccattgacaaggaccctgagccaacctcaacggtagacagggagttgaaagacgctgaaattgtcattactacgccctttttccccgcctacatctcgagaaacaggattgcagaagctcctaacctgaagctctgtgtaaccgctggcgtcggttcagaccatgtcgatttagaagctgcaaatgaacggaaaatcacggtcaccgaagttactggttctaacgtcgtttctgtcgcagagcacgttatggccacaattttggttttgataagaaactataatggtggtcatcaataagcaattaatggtgagtgggatattgccggcgtggctaaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctgcatgctcaaaagaggtacgctcagggagtaaagaacatcctaaatagttacttttccaaaaagtttgattaccgtccacaggatattattgtgcagaatggttcttatgccaccagagcttatggacagaagaaataa

SEQ ID NO: 202 - protein, 145 aa, Saccharomyces cerevisiae S288C
  MISC_FEATURE: FDH2 (YPL276W)
MSKGKVLLVLYEGGKHAEEQEKLLGCIENELGIRNFIEEQGYELVTTIDKDPEPTSTVDRELKDAEIVITTPFFPAYISRNRIAEAPNLKLCVTAGVGSDHVDLEAANERKITVTEVTGSNVVSVAEHVMATILVLIRNYNGGHQ

SEQ ID NO: 203 - protein, 236 aa, Saccharomyces cerevisiae S288C
  MISC_FEATURE: FDH2 (YPL275W)
MVVINKQLMVSGILPAWLKNEYDLEDKIISTVGAGRIGYRVLERLVAFNPKKLLYYDYQELPAEAINRLNEASKLFNGRGDIVQRVEKLEDMVAQSDVVTINCPLHKDSRGLFNKKLISHMKDGAYLVNTARGAICVAEDVAEAVKSGKLAGYGGDVWDKQPAPKDHPWRTMDNKDHVGNAMTVHISGTSLHAQKRYAQGVKNILNSYFSKKFDYRPQDIIVQNGSYATRAYGQKK

SEQ ID NO: 204 - DNA, 1323 bp, Saccharomyces cerevisiae PE-2
  misc_feature: GPD2
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacagatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgaaacctactatcaagaatccgctggtattgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatag

SEQ ID NO: 205 - protein, 440 aa, Saccharomyces cerevisiae PE-2
  MISC_FEATURE: GPD2
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGIADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 206 - DNA, 1176 bp, Saccharomyces cerevisiae PE-2
  misc_feature: GPD1
atgtctgctgctgctgatagattaaacttaacttccggccacttgaatgctggtagaaagagaagttcctcttctgtttctttgaaggctgccgaaaagcctttcaaggttactgtgattggatctggtaattggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctgaagggttttgaagttggtgctaaaggtgtccaattgctatcctcttacatcactgaggaactaggtattcaatgtggtgctctatctggtgctaacattgccactgaagtcgctcaagaacactggtctgaaacaacagttgcttaccacattccaaaggatttcaggggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagagtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattag

SEQ ID NO: 207 - protein, 391 aa, Saccharomyces cerevisiae PE-2
  MISC_FEATURE: GPD1
MSAAADRLNLTSGHLNAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 208 - DNA, 477 bp, Saccharomyces cerevisiae PE-2
  misc_feature: FCY1
atggtgacagggggaatggcaagcaagtgggatcagaagggtatggacattgcctatgaggaggcggccttaggttacaaagagggtggtgttcctattggcggatgtcttatcaataacaaagacggaagtgttctcggtcgtggtcacaacatgagatttcaaaagggatccgccacactacatggtgagatctccactttggaaaactgtgggagattagagggcaaagtgtacaaagataccactttgtatacgacgctgtctccatgcgacatgtgtacaggtgccatcatcatgtatggtattccacgctgtgttgtcggtgagaacgttaatttcaaaagtaagggcgagaaatatttacaaactagaggtcacgaggttgttgttgttgacgatgagaggtgtaaaaagatcatgaaacaatttatcgatgaaagacctcaggattggtttgaagatattggtgagtag

SEQ ID NO: 209 - protein, 158 aa, Saccharomyces cerevisiae PE-2
  MISC_FEATURE: FCY1
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 210 - DNA, 213 bp, Saccharomyces cerevisiae PE-2
  misc_feature: YLR296W
atgggcagttctcgcgttattcgtcatcaggcaagtaattatgcccaatcagcttaccaatgtcacataaaggaaccactattatccctttttggtaatgaaaaacaacactcttccggtacgacagccgctgcggcaattacttttccccaaaagctcataatcgatcaattaacgcgtaaacgaaaaacaaaaaaaaattacgtaaattag

SEQ ID NO: 211 - protein, 70 aa, Saccharomyces cerevisiae PE-2
  MISC_FEATURE: YLR296W
MGSSRVIRHQASNYAQSAYQCHIKEPLLSLFGNEKQHSSGTTAAAAITFPQKLIIDQLTRKRKTKKNYVN

SEQ ID NO: 212 - DNA, 1710 bp, Saccharomyces cerevisiae M2390
  misc_feature: STL1
atgaaggatttaaaattatcgaatttcaaaggcaaatttataagcagaaccagtcactggggacttacgggtaagaagttgcggtatttcatcactatcgcatctatgacgggcttctccctgtttggatacgaccaagggttgatggcaagtctaattactggtaaacagttcaactatgaatttccagcaaccaaagaaaatggcgatcatgacagacacgcaactgtagtgcagggcgctacaacctcctgttatgaattaggttgtttcgcaggttctctattcgttatgttctgcggtgaaagaattggtagaaaaccattaatcctgatgggttccgtaataaccatcattggtgccgttatttctacatgcgcatttcgtggttactgggcattaggccagtttatcatcggaagagtcgtcactggtgttggaacagggttgaatacatctactattcccgtttggcaatcagaaatgtcaaaagctgaaaatagagggttgctggtcaatttagaaggttccacaattgcttttggtactatgattgcttattggattgattttgggttgtcttataccaacagttctgttcagtggagattccccgtgtcaatgcaaatcgtttttgctctcttcctgcttgctttcatgattaaactacctgaatcgccacgttggctgatttctcaaagtcgaacagaagaagctcgctacttggtaggaacactagacgacgcggatccaaatgatgaggaagttataacagaagttgctatgcttcacgatgctgttaacaggaccaaacacgagaaacattcactgtcaagtttgttctccagaggcaggtcccaaaatcttcagagggctttgattgcagcttcaacgcaatttttccagcaatttactggttgtaacgctgccatatactactctactgtattattcaacaaaacaattaaattagactatagattatcaatgatcataggtggggtcttcgcaacaatctacgccttatctactattggttcattttttctaattgaaaagctaggtagacgtaagctgtttttattaggtgccacaggtcaagcagtttcattcacaattacatttgcatgcttggtcaaagaaaataaagaaaacgcaagaggtgctgccgtcggcttatttttgttcattacattctttggtttgtctttgctatcattaccatggatatacccaccagaaattgcatcaatgaaagttcgtgcatcaacaaacgctttctccacatgtactaattggttgtgtaactttgcggttgtcatgttcaccccaatatttattggacagtccggttggggttgctacttattttttgctgttatgaattatttatacattccagttatcttctttttctaccctgaaaccgccggaagaagtttggaggaaatcgacatcatctttgctaaagcatacgaggatggcactcaaccatggagagttgctaaccatttgcccaagttatccctacaagaagtcgaagatcatgccaatgcattgggctcttatgacgacgaaatggaaaaagaggactttggtgaagatagagtagaagacacctataaccaaattaacggcgataattcgtctagttcttcaaacatcaaaaatgaagatacagtgaacgataaagcaaattttgagggttga

SEQ ID NO: 213 - protein, 569 aa, Saccharomyces cerevisiae M2390; identical to SEQ ID NO: 140
  MISC_FEATURE: STL1

SEQ ID NO: 214 - DNA, 939 bp, Saccharomyces cerevisiae M2390
  misc_feature: GCY1
atgcctgctactttgcatgattctacgaaaatcctttctctaaatactggagcccaaatccctcaaataggtttaggtacgtggcagtcgaaagagaacgatgcttataaggctgttttagccgctttgaaagatggctaccgacacattgatactgctgctatttaccgtaatgaagaccaagtcggtcaagccatcaaggattcaggtgttcctcgggaagaaatctttgttactacaaagttatggtgtacacaacaccacgaacctgaagtagcgctggatcaatcactaaaaaggttaggattggactacgtagacttgtatttgatgcattggcctgccagattagatccagcctacatcaaaaatgaagacatcttgagtgtgccaacaaagaaggatggttctcgtgcagtggatatcaccaattggaatttcatcaaaacctgggaattaatgcaggaactaccaaagactggtaaaactaaggccgttggagtctccaacttttctataaataacctgaaagatctattagcatctcaaggtaataagcttacgccagctgctaaccaagtcgaaatacatccattactacctcaagacgaattgattaatttttgtaaaagtaaaggcattgtggttgaagcttattctccgttaggtagtaccgatgctccactattgaaggaaccggttatccttgaaattgcgaagaaaaataacgttcaacccggacacgttgttattagctggcacgtccaaagaggttatgttgtcttgccaaaatctgtgaatcccgatcgaatcataacgaacaggaaaatatttactttgtctactgaggactttgaagctatcaataacatatcgaaggaaaagggcgaaaaaagggttgtacatccaaattggtctcctttcgaagtattcaagtaa

SEQ ID NO: 215 - protein, 312 aa, Saccharomyces cerevisiae M2390
  MISC_FEATURE: GCY1
MPATLHDSTKILSLNTGAQIPQIGLGTWQSKENDAYKAVLAALKDGYRHIDTAAIYRNEDQVGQAIKDSGVPREEIFVTTKLWCTQHHEPEVALDQSLKRLGLDYVDLYLMHWPARLDPAYIKNEDILSVPTKKDGSRAVDITNWNFIKTWELMQELPKTGKTKAVGVSNFSINNLKDLLASQGNKLTPAANQVEIHPLLPQDELINFCKSKGIVVEAYSPLGSTDAPLLKEPVILEIAKKNNVQPGHVVISWHVQRGYVVLPKSVNPDRIITNRKIFTLSTEDFEAINNISKEKGEKRVVHPNWSPFEVFK

SEQ ID NO: 216 - DNA, 1755 bp, Saccharomyces cerevisiae M2390
  misc_feature: DAK1
atgtccgctaaatcgtttgaagtcacagatccagtcaattcaagtctcaaagggtttgcccttgctaacccctccattacgctggtccctgaagaaaaaattctcttcagaaagaccgattccgacaagatcgcattaatttctggtggtggtagtggacatgaacctacacacgccggtttcattggtaagggtatgttgagtggcgccgtggttggcgaaatttttgcatccccttcaacaaaacagattttaaatgcaatccgtttagtcaatgaaaatgcgtctggcgttttattgattgtgaagaactacacaggtgatgttttgcattttggtctgtccgctgagagagcaagagccttgggtattaactgccgcgttgctgtcataggtgatgatgttgcagttggcagagaaaagggtggtatggttggtagaagagcattggcaggtaccgttttggttcataagattgtaggtgccttcgcagaagaatattctagtaagtatggcttagacggtacagctaaagtggctaaaattatcaacgacaatttggtgaccattggatcttctttagaccattgtaaagttcctggcaggaaattcgaaagtgaattaaacgaaaaacaaatggaattgggtatgggtattcataacgaacctggtgtgaaagttttagaccctattccttctaccgaagacttgatctccaagtatatgctaccaaaactattggatccaaacgataaggatagagcttttgtaaagtttgatgaagatgatgaagttgtcttgttagttaacaatctcggcggtgtttctaattttgttattagttctatcacttccaaaactacggatttcttaaaggaaaattacaacataaccccggttcaaacaattgctggcacattgatgacctccttcaatggtaatgggttcagtatcacattactaaacgccactaaggctacaaaggctttgcaatctgattttgaggagatcaaatcagtactagacttgttgaacgcatttacgaacgcaccgggctggccaattgcagattttgaaaagacttctgccccatctgttaacgatgacttgttacataatgaagtaacagcaaaggccgtcggtacctatgactttgacaagtttgctgagtggatgaagagtggtgctgaacaagttatcaagagcgaaccgcacattacggaactagacaatcaagttggtgatggtgattgtggttacactttagtggcaggagttaaaggcatcaccgaaaaccttgacaagctgtcgaaggactcattatctcaggcggttgcccaaatttcagatttcattgaaggctcaatgggaggtacttctggtggtttatattctattcttttgtcgggtttttcacacggattaattcaggtttgtaaatcaaaggatgaacccgtcactaaggaaattgtggctaagtcactcggaattgcattggatactttatacaaatatacaaaggcaaggaagggatcatccaccatgattgatgctttagaaccattcgttaaagaatttactgcatctaaggatttcaataaggcggtaaaagctgcagaggaaggtgctaaatccactgctacattcgaggccaaatttggcagagcttcgtatgtcggcgattcatctcaagtagaagatcctggtgcagtaggcctatgtgagtttttgaagggggttcaaagcgccttgtaa

SEQ ID NO: 217 - protein, 584 aa, Saccharomyces cerevisiae M2390
  MISC_FEATURE: DAK1
MSAKSFEVTDPVNSSLKGFALANPSITLVPEEKILFRKTDSDKIALISGGGSGHEPTHAGFIGKGMLSGAVVGEIFASPSTKQILNAIRLVNENASGVLLIVKNYTGDVLHFGLSAERARALGINCRVAVIGDDVAVGREKGGMVGRRALAGTVLVHKIVGAFAEEYSSKYGLDGTAKVAKIINDNLVTIGSSLDHCKVPGRKFESELNEKQMELGMGIHNEPGVKVLDPIPSTEDLISKYMLPKLLDPNDKDRAFVKFDEDDEVVLLVNNLGGVSNFVISSITSKTTDFLKENYNITPVQTIAGTLMTSFNGNGFSITLLNATKATKALQSDFEEIKSVLDLLNAFTNAPGWPIADFEKTSAPSVNDDLLHNEVTAKAVGTYDFDKFAEWMKSGAEQVIKSEPHITELDNQVGDGDCGYTLVAGVKGITENLDKLSKDSLSQAVAQISDFIEGSMGGTSGGLYSILLSGFSHGLIQVCKSKDEPVTKEIVAKSLGIALDTLYKYTKARKGSSTMIDALEPFVKEFTASKDFNKAVKAAEEGAKSTATFEAKFGRASYVGDSSQVEDPGAVGLCEFLKGVQSAL

SEQ ID NO: 218 - DNA, 2733 bp, Bifidobacterium adolescentis
  misc_feature: AdhE
atggccgacgccaagaagaaagaagaacctactaagccaaccccagaagaaaaattggctgctgctgaagctgaagttgatgctttggttaagaaaggtttgaaggccttggacgaattcgaaaaattggatcaaaagcaagtcgatcacatcgttgctaaagcttcagttgctgctttgaacaaacatttggttttggctaagatggccgttgaagaaactcatagaggtttggttgaagataaggccaccaagaatattttcgcttgtgaacatgtcaccaactatttggctggtcaaaagaccgttggtatcattagagaagatgatgttttgggtatcgacgaaattgctgaaccagttggtgttgttgctggtgttactccagttactaatccaacttctaccgctattttcaagtccttgattgccttgaaaaccagatgcccaattatctttggttttcatccaggtgctcaaaactgttctgttgctgctgctaaaatcgttagagatgctgctattgctgctggtgctccagaaaactgtattcaatggattgaacacccatccattgaagctactggtgctttgatgaagcacgatggtgttgctactattttggctactggtggtccaggtatggttaaggctgcttattcttctggtaaaccagctttgggtgttggtgctggtaatgctccagcttatgttgataagaacgttgatgttgttagagctgccaacgatttgattttgtctaagcacttcgactacggtatgatttgtgctactgaacaagctattatcgccgataaggatatctatgctccattggtcaaagaattgaagagaagaaaggcctacttcgttaatgctgacgaaaaagctaagttggaacagtatatgttcggttgtaccgcttactctggtcaaactccaaagttgaattctgttgttccaggtaagtccccacagtatattgctaaagctgccggtttcgaaattccagaagatgctacaattttggccgctgaatgtaaagaagtcggagaaaacgaaccattgaccatggaaaaattggcaccagttcaagctgttttgaagtccgataacaaagaacaagccttcgaaatgtgcgaagccatgttgaaacatggtgctggtcatactgctgctattcatacaaacgatagagacttggtcagagaatacggtcaaagaatgcatgcctgcagaattatttggaactctccatcttctttgggtggtgttggtgatatctacaatgctattgctccatctttgactttgggttgtggttcttatggtggtaattctgtttccggtaatgttcaagccgtcaacttgattaacatcaagagaatcgctagaagaaacaacaacatgcaatggttcaagattccagctaagacttactttgaacctaacgccatcaagtacctaagagatatgtacggtatcgaaaaggctgttatcgtttgcgataaggtcatggaacaattgggtatcgttgataagatcatcgatcaattgagagccagatctaacagagttaccttcagaatcatcgattacgttgaaccagaaccatctgttgaaacagttgaaaggggtgctgctatgatgagagaagaatttgaacctgataccattattgctgttggtggtggttctccaatggatgcttctaagattatgtggttgttgtacgaacacccagaaatttcattctccgatgtcagagaaaagttcttcgacattagaaagagagcctttaagattccaccattgggtaaaaaggccaagttggtatgtattccaacctcttcaggtactggttctgaagttactccattcgctgttattaccgatcataagactggttacaagtacccaattaccgattatgctttgactccatctgttgctatcgttgatccagttttggctagaactcaacctagaaaattggcttctgatgctggttttgatgctttgacacatgcttttgaagcctacgtttctgtttacgctaacgatttcactgatggtatggctttacatgctgctaaattggtttgggataacttggctgaatccgttaatggtgaaccaggtgaagaaaaaactagagcccaagaaaagatgcataacgctgctactatggctggtatggcatttggttctgcttttttgggtatgtgtcatggtatggctcatacaattggtgctttgtgtcatgttgctcatggtagaactaactccattttgttgccatacgtcatcagatacaacggttctgttcctgaagaacctacatcttggccaaagtacaacaagtatattgccccagaaagataccaagaaatcgctaagaacttgggtgttaatccaggtaaaactcctgaagaaggtgttgaaaatttggctaaggctgtcgaagattacagagataacaagttgggtatgaacaagtccttccaagaatgtggtgttgacgaagattactactggtccattatcgatcaaattggtatgagagcctacgaagatcaatgtgctccagctaatccaagaattccacaaatcgaagatatgaaggatattgctattgccgcttactacggtgtttctcaagctgaaggtcataagttgagagttcaaagacaaggtgaagctgctacagaagaagcttctgaaagagcttaa

SEQ ID NO: 219 - protein, 910 aa, Bifidobacterium adolescentis; identical to SEQ ID NO: 103
  MISC_FEATURE: AdhE

SEQ ID NO: 220 - DNA, 879 bp, Bifidobacterium adolescentis
  misc_feature: PflA
atgtccgaacacatcttcagatccactactagacacatgttgagagattccaaggactacgttaatcaaactttgatgggtggtttgtctggtttcgaatctccaattggtttggatagattggacagaatcaaggctttgaagtctggtgatatcggttttgttcattcctgggatattaacacctctgttgatggtccaggtactagaatgactgtttttatgtctggttgcccattgagatgtcaatactgtcaaaatccagacacctggaaaatgagagatggtaaaccagtttactacgaagccatggtcaaaaagattgaaagatacgccgatttgttcaaagctactggtggtggtattactttttctggtggtgaatctatgatgcaaccagcttttgtttccagagtttttcatgctgctaagcaaatgggtgttcatacttgtttggatacctctggttttttgggtgcttcttacactgatgatatggttgatgatatcgacttgtgcttgttggatgttaagtcaggtgatgaagaaacctaccataaggttaccggtggtattttacaacctaccattgatttcggtcaaagattggctaaagccggtaaaaagatctgggttagattcgttttggtcccaggtttgacttcttctgaagaaaatgttgaaaacgtcgccaagatttgtgaaacttttggtgatgccttggaacacattgatgttttgccatttcaccaattgggtagaccaaaatggcacatgttgaatattccatacccattggaagatcaaaagggtccatctgctgctatgaagcaaagagttgttgaacaattccaatcccatggtttcaccgtttactaa

SEQ ID NO: 221 - protein, 292 aa, Bifidobacterium adolescentis; identical to SEQ ID NO: 40
  MISC_FEATURE: PflA

SEQ ID NO: 222 - DNA, 2376 bp, Bifidobacterium adolescentis
  misc_feature: PflB
atggctgctgttgatgctaccgctgtttctcaagaagaattggaagctaaagcttgggaaggttttactgaaggtaactggcaaaaggatatcgatgttagagacttcatccaaaagaactacactccatacgaaggtgatgaatcttttttggctgatgctaccgataagaccaaacatttgtggaaatacttggacgacaactacttgtccgtcgaaagaaaacaaagagtttacgacgttgatactcatactccagctggtattgatgcttttccagctggttatattgattccccagaagttgataacgtcatcgttggtttacaaaccgatgttccatgtaagagggctatgatgccaaatggtggttggagaatggttgaacaagctatcaaagaagccggtaaagaaccagatccagaaatcaagaagatcttcaccaagtacagaaagacccataacgatggtgtttttggtgtttacaccaagcaaatcaaggttgctagacacaacaagattttgactggtttgccagatgcttatggtagaggtagaattatcggtgattatagaagagttgccttgtacggtgttaacgctttgattaagttcaagcaaagagacaaggactccattccatacagaaacgatttcaccgaaccagaaatcgaacattggatcagattcagagaagaacacgacgaacaaatcaaggctttgaagcaattgatcaacttgggtaacgaatacggtttggatttgtctagaccagctcaaactgctcaagaagctgttcaatggacttatatgggttatttggcttccgttaagtctcaagatggtgctgctatgtcttttggtagagtttctaccttcttcgacgtctacttcgaaagagatttgaaggctggtaagattactgaaaccgatgcccaagaaatcatcgataacttggtcatgaagttgagaatcgtcagattcttgagaactaaggattacgatgccattttctctggtgatccatattgggctacttggtctgatgctggttttggtgatgatggtagaactatggttaccaagacctccttcagattattgaacactttgaccttggaacatttgggtccaggtccagaacctaacattactattttttgggacccaaagttgccagaagcttacaaaagattctgcgccagaatttctattgatacctccgctattcaatacgaatccgacaaagaaatcagatctcattggggtgatgatgctgctattgcttgttgtgtttctccaatgagagtcggtaagcaaatgcaatttttcgctgctagagtcaactctgctaaggctttgttgtacgctattaacggtggtagagacgaaatgactggtatgcaagtcatcgataagggtgttatcgatccaatcaaacctgaagctgatggtactttggactacgaaaaggttaaggctaattacgaaaaggccttggaatggttgtctgaaacttatgttatggccttgaacatcatccattacatgcatgataagtacgcctacgaatctattgaaatggccttgcatgacaaagaagtctatagaactttgggttgtggtatgtctggtttgtctattgctgctgattctttgtctgcttgtaagtacgctaaggtttacccaatctacaacaaggatgctaaaactactccaggtcacgaaaacgaatatgttgaaggtgctgatgatgatttgatcgttggttatagaaccgaaggtgactttccattatacggtaacgatgatgatagagctgatgatattgccaagtgggttgtttctactgttatgggtcaagttaagagattgccagtttacagagatgctgttccaacccaatccattttgactattacctccaacgtcgaatacggtaaagctactggtgcttttccatcaggtcataagaaaggtactccatatgctccaggtgctaatccagaaaatggtatggattctcatggtatgttgccatctatgttctccgttggtaagatcgattacaacgatgctttggatggtatttctttgaccaacactattaccccagatggtttgggtagagacgaagaagaaagaatcggtaacttggttggtattttggatgctggtaatggtcatggtctataccatgctaacatcaacgtcttgagaaaagaacaattggaagatgccgttgaacacccagaaaagtatccacatttgaccgttagagtttctggttacgctgttaacttcgtcaagttgaccaaagaacaacaattggatgtcatctccagaacttttcatcaaggtgctgttgttgattaa

SEQ ID NO: 223 - protein, 791 aa, Bifidobacterium adolescentis; identical to SEQ ID NO: 74
  MISC_FEATURE: PflB

SEQ ID NO: 224 - DNA, 1710 bp, Saccharomyces paradoxus
  misc_feature: STL1
atgaaggactccaagttgtctaagttcaagggtagattcatgtccagaacttctcattggggtttgactggtcaaaagttgagatacttcattaccattgcttctatgaccggtttctctttgtttggttatgaccaaggtttgatggcctctttgattactggtaagcaattcaactacgaattcccagctaccaaagaaaacggtgatcatgatagacatgctaccgttgttcaaggtgctactacttcttgttatgaattgggttgtttcgccggttctttgttcgttatgttttacggtgaaagaatcggtagaaagccattgattttgatgggttccattatcaccattatcggtgctgttatttctacctgtgctttcagagattattgggctttgggtcaattcatcgttggtagagttgttactggtgttggtactggtttgaacacttctactattccagtttggcaatccgaaatgtctaaggctgaaaacagaggtttgttggttaacttggaaggttccactattgctttcggtactatgattgcttactggatcgatttcggtttttcctacactaactcttccgttcaatggagatttccagtctctatgcaaatcgttttcgccttgtttttgttggccttcatgattaagttgccagaatctccaagatggttgatctctcaatctagaactgaagaagccagatacttggttggtactttggatgatactgatccaaacgatgaagaagttattaccgaagttgccatgttgcatgatgccgttaatagaactaagcacgaaaagcactcattgtcatccttgttttctagaggtaagtcccaaaacttgcaaagagctttgattgctgcttctacccaattcttccaacaattcactggttgtaatgctgccatctactactctactgttttgttcaacaagaccatcaagttggaccacagattgtccatgattattggtggtgttttcgctactatctacgccttgtctactattggttccttcttcttgatcgaaaaattaggtagaagaaagttgttcttgttgggtgctactggtcaagctgtttctttcactattacctttgcttgcttggtaaaagaaaacaaagaaaatgctagaggtgctgccgttggtttgttcttattcattactttcttcggtttgtccttgttgtctttgccatggatctatccaccagaaattgcttcaatgaaggttagagcatctaccaatgctttctctacttgtacaaactggttgtgcaatttcgccgttgttatgttcaccccaattttcattggtcaatctggttggggttgttacttgttttttgccgttatgaactacttgtatatcccagttatattctttttctaccctgaaaccgctggtagatccttggaagaaattgatattatcttcgccaaggcctacgaagatggtactcaaccttggagagttgctaatcatttgccaaagttgtccttgcaagaagttgaagatcacgctaatgctttgggttcttatgatgacgaaatggaaaaggatgatttcgccgaagatagagtcgaagatacctacaatcaaatcaacggtgacaactcctcttcctcctctaatatcaaaaacgaagatactgttaacgacaaggccaactctgaatcttga

SEQ ID NO: 225 - protein, 569 aa, Saccharomyces paradoxus
  MISC_FEATURE: STL1
MKDSKLSKFKGRFMSRTSHWGLTGQKLRYFITIASMTGFSLFGYDQGLMASLITGKQFNYEFPATKENGDHDRHATVVQGATTSCYELGCFAGSLFVMFYGERIGRKPLILMGSIITIIGAVISTCAFRDYWALGQFIVGRVVTGVGTGLNTSTIPVWQSEMSKAENRGLLVNLEGSTIAFGTMIAYWIDFGFSYTNSSVQWRFPVSMQIVFALFLLAFMIKLPESPRWLISQSRTEEARYLVGTLDDTDPNDEEVITEVAMLHDAVNRTKHEKHSLSSLFSRGKSQNLQRALIAASTQFFQQFTGCNAAIYYSTVLFNKTIKLDHRLSMIIGGVFATIYALSTIGSFFLIEKLGRRKLFLLGATGQAVSFTITFACLVKENKENARGAAVGLFLFITFFGLSLLSLPWIYPPEIASMKVRASTNAFSTCTNWLCNFAVVMFTPIFIGQSGWGCYLFFAVMNYLYIPVIFFFYPETAGRSLEEIDIIFAKAYEDGTQPWRVANHLPKLSLQEVEDHANALGSYDDEMEKDDFAEDRVEDTYNQINGDNSSSSSNIKNEDTVNDKANSES

SEQ ID NO: 226 - protein, 335 aa, Saccharomyces cerevisiae
  MISC_FEATURE: TAL1
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKIYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 227 - protein, 600 aa, Saccharomyces cerevisiae
  MISC_FEATURE: XKS1
MLCSVIQRQTREVSNTMSLDSYYLGFDLSTQQLKCLAINQDLKIVHSETVEFEKDLPHYHTKKGVYIHGDTIECPVAMWLEALDLVLSKYREAKFPLNKVMAVSGSCQQHGSVYWSSQAESLLEQLNKKPEKDLLHYVSSVAFARQTAPNWQDHSTAKQCQEFEECIGGPEKMAQLTGSRAHFRFTGPQILKIAQLEPEAYEKTKTISLVSNFLTSILVGHLVELEEADACGMNLYDIRERKFSDELLHLIDSSSKDKTIRQKLMRAPMKNLIAGTICKYFIEKYGFNTNCKVSPMTGDNLATICSLPLRKNDVLVSLGTSTTVLLVTDKYHPSPNYHLFIHPTLPNHYMGMICYCNGSLARERIRDELNKERENNYEKTNDWTLFNQAVLDDSESSENELGVYFPLGEIVPSVKAINKRVIFNPKTGMIEREVAKFKDKRHDAKNIVESQALSCRVRISPLLSDSNASSQQRLNEDTIVKFDYDESPLRDYLNKRPERTFFVGGASKNDAIVKKFAQVIGATKGNFRLETPNSCALGGCYKAMWSLLYDSNKIAVPFDKFLNDNFPWHVMESISDVDNENWDRYNSKIVPLSELEKTLI

SEQ ID NO: 228 - protein, 680 aa, Saccharomyces cerevisiae
  MISC_FEATURE: TKL1
MTQFTDIDKLAVSTIRILAVDTVSKANSGHPGAPLGMAPAAHVLWSQMRMNPTNPDWINRDRFVLSNGHAVALLYSMLHLTGYDLSIEDLKQFRQLGSRTPGHPEFELPGVEVTTGPLGQGISNAVGMAMAQANLAATYNKPGFTLSDNYTYVFLGDGCLQEGISSEASSLAGHLKLGNLIAIYDDNKITIDGATSISFDEDVAKRYEAYGWEVLYVENGNEDLAGIAKAIAQAKLSKDKPTLIKMTTTIGYGSLHAGSHSVHGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLTPSNLTRWKEALDFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSRQNLPQLEGSSIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGASGKAPEVFKFFGFTPEGVAERAQKTIAFYKGDKLISPLKKAF

SEQ ID NO: 229 - protein, 258 aa, Saccharomyces cerevisiae
  MISC_FEATURE: RKI1
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEK

What is claimed is:

1. A recombinant yeast comprising:
    (a) a heterologous Sugar Transporter-Like protein (STL1); and
    (b) a heterologous enzyme comprising an acetaldehyde dehydrogenase and/or a bifunctional acetaldehyde/alcohol dehydrogenase; and
    wherein the recombinant yeast produces increased ethanol relative to a control recombinant yeast without said heterologous STL1 protein.

2. The recombinant yeast of claim 1, wherein the recombinant yeast further comprises one or more native and/or heterologous proteins that function to export glycerol from the yeast, wherein said one or more native and/or heterologous enzymes that function to export glycerol is activated, upregulated, or downregulated.

3. The recombinant yeast of claim 1, wherein the recombinant yeast further comprises a deletion or downregulation of one or more native enzymes that function to produce glycerol and/or regulate glycerol synthesis.

4. The recombinant yeast of claim 1, wherein said one or more engineered metabolic pathways comprises conversion of pyruvate to acetyl-CoA and formate.

5. The recombinant yeast of claim 1, wherein said one or more engineered metabolic pathways is the pentose phosphate pathway (PPP).

6. The recombinant yeast of claim 1, wherein said one or more engineered metabolic pathways comprises the conversion of acetate to acetyl-CoA.

7. The recombinant yeast of claim 1, wherein said one or more engineered metabolic pathways comprises one or more native and/or heterologous enzymes that encodes a saccharolytic enzyme.

8. The recombinant yeast of claim 1, wherein said yeast further comprises one or more native and/or heterologous enzymes that function in one or more engineered metabolic pathways to convert xylose to xylulose-5-phosphate and/or arabinose to xylulose-5-phosphate, wherein said one or more native and/or heterologous enzymes is activated, upregulated or downregulated.

9. The recombinant yeast of claim 1, wherein said one or more engineered metabolic pathways comprises the conversion of trehalose to acetyl-CoA.

10. The recombinant yeast of claim 9, wherein said one or more native and/or heterologous enzymes functions to convert trehalose to glucose.

11. A method for decreasing cellular-produced glycerol comprising contacting biomass with a recombinant yeast according to claim 1.

12. A process for converting biomass to ethanol comprising contacting biomass with a recombinant yeast according to claim 1.

13. A process for converting biomass to isopropanol comprising contacting biomass with a recombinant yeast according to claim 1.

14. The recombinant yeast of claim 1, wherein said yeast comprises intracellular glycerol.

15. The recombinant yeast of claim 1, further comprising a functional GPD1 gene and/or a functional GPD2 gene.

16. The recombinant yeast of claim 1, wherein said heterologous STL1 comprises an STL1 protein from a yeast selected from the group consisting of: S. cerevisiae, P. sorbitophila, and Saccharomyces paradoxus.

17. The recombinant yeast of claim 1, wherein said heterologous STL1 protein comprises an amino acid sequence selected from the group consisting of: SEQ ID NO: 140, SEQ ID NO: 142, SEQ ID NO: 10, and SEQ ID NO: 225.

18. The recombinant yeast of claim 1, said yeast being S. cerevisiae.

19. The recombinant yeast of claim 1, wherein said yeast is able to grow anaerobically independent of the presence of externally supplied glycerol.

20. The recombinant yeast of claim 1, wherein said yeast produces less glycerol than said recombinant yeast without said heterologous STL1.

21. The recombinant yeast of claim 1, said yeast being from the genera *Saccharomyces*.

22. The recombinant yeast of claim 14, wherein the STL1 increases intracellular glycerol concentration by about 0.05 fold to about 5 fold more intracellular glycerol than is present in a recombinant yeast without the heterologous STL1.

23. The recombinant yeast of claim 14, wherein the STL reduces glycerol formation by 12% to 23% of the glycerol produced by a recombinant yeast without the heterologous STL1.

24. The recombinant yeast of claim 14, wherein the STL1 increases intracellular glycerol concentration by at least 0.05-fold more intracellular glycerol than is present in a recombinant yeast without the heterologous STL1.

25. The recombinant yeast of claim 14, wherein the STL1 reduces glycerol formation by more than 5% of the glycerol produced by a recombinant yeast without the heterologous STL1.

* * * * *